United States Patent 10,746,735 (MARKER SEQUENCES FOR DIAGNOSING AND STRATIFYING SLE PATIENTS) - sequence listing, part 2

SEQ ID NO: 1340 - protein, 5005 aa, Human
MDQRKNESIVPSITQLEDFLTEHNSNVVWLLVATILSCGWIIYLTYYNSRNVGLILTLVLNRLYKHGYIHIGSFSFSVLSGKVMVREIYYITEDMSIRIQDGFIIFRWWKMYNPKQKQHDPKAETRLYITVNDFEFHVYNRSDLYGRLQELFGLEPTIIPPKKDDDKTREIGRTRTQSKIERVKVKTESQDPTSSWRSLIPVIKVNVSTGRLAFGNHYQPQTLCINFDDAFLTYTTKPPSSHLDQFMHIVKGKLENVRVMLVPSPRYVGLQNDEPPRLMGEGFVVMQSNDVDIYYYMDEPGLVPEETEENIEGEMSSEDCKLQDLPPCWGLDIVCGKGTDFNYGPWADRQRDCLWKFFFPPDYQVLKVSEIAQPGRPRQILAFELRMNIIADATIDLLFTKNRETNAVHVNVGAGSYLEINIPMTVEENGYTPAIKGQLLHVDATTSMQYRTLLEAEMLAFHINASYPRIWNMPQTWQCELEVYKATYHFIFAQKNFFTDLIQDWSSDSPPDIFSFVPYTWNFKIMFHQFEMIWAANQHNWIDCSTKQQENVYLAACGETLNIDFSLPFTDFVPATCNTKFSLRGEDVDLHLFLPDCHPSKYSLFMLVKNCHPNKMIHDTGIPAECQSGQKTVKPKWRNVTQEKSGWVECWTVPSVMLTIDYTWHPIYPQKADEQLKQSLSEMEETMLSVLRPSQKTSDRVVSSPSTSSRPPIDPSELPPDKLHVEMELSPDSQITLYGPLLNAFLCIKENYFGEDDMYMDFEEVISSPVLSLSTSSSSGWTAVGMENDKKENEGSAKSIHPLALRPWDITVLVNLYKVHGRLPVHGTTDGPECPTAFLERLCFEMKKGFRETMLQLILSPLNVFVSDNYQQRPPVDEVLREGHINLSGLQLRAHAMFSAEGLPLGSDSLEYAWLIDVQAGSLTAKVTAPQLACLLEWGQTFVFHVVCREYELERPKSVIICQHGIDRRFCESKLSCIPGPCPTSDDLKYTMIRLAVDGADIYIVEHGCATNIKMGAIRVANCNLHNQSVGEGISAAIQDFQVRQYIEQLNNCRIGLQPAVLRRAYWLEAGSANLGLITVDIALAADHHSKHEAQRHFLETHDARTKRLWFLWPDDILKNKRCRNKCGCLGGCRFFGGTVTGLDFFKLEELTPSSSSAFSSTSAESDMYYGQSLLQPGEWIITKEIPKIIDGNVNGMKRKEWENKSVGIEVERKTQHLSLQVPLRSHSSSSSSEENSSSSAAQPLLAGEKESPSSVADDHLVQKEFLHGTKRDDGQASIPTEISGNSPVSPNTQDKSVGQSPLRSPLKRQASVCSTRLGSTKSLTAAFYGDKQPVTVGVQFSSDVSRSDENVLDSPKQRRSFGSFPYTPSADSNSFHQYRSMDSSMSMADSEAYFSAAEEFEPISSDEGPGTYPGRKKKKKQTQQIDYSRGSIYHSVEGPLTGHGESIQDSRTLPFKTHPSQASFVSALGGEDDVIEHLYIVEGEKTVESEQITPQQPVMNCYQTYLTQFQVINWSVKHPTNKRTSKSSLHRPLDLDTPTSEESSSSFEQLSVPTFKVIKQGLTANSLLDRGMQLSGSTSNTPYTPLEKKLADNTDDETLTEEWTLDQPVSQTRTTAIVEVKGTVDIVLTPLVAEALDRYIEAMVHCASTRHPAAIVDDLHAKVLREAVQNSKTTFSENLSSKQDIRGTKTEQSTIGTTNQGQAQTNLTMKQDNVTIKGLQTNVSIPKVNLCLLQASVEESPTTAPSRSVTHVSLVALCFDRIATQVRMNRGVVEETSNNAEPGRTSNFDRYVHATKMQPQSSGSLRSNAGAEKGKEIAAKLNIHRVHGQLRGLDTTDIGTCAITAIPFEKSKVLFTLEELDEFTFVDETDQQAVPDVTRIGPSQEKWGWIMFECGLENLTIKGGRQSGAVLYNSFGIMGKASDTERGGVLTSNNSSDSPTGSGYNTDVSDDNLPCDRTSPSSDLNGNSVSDEQDEGVESDDLKKDLPLMPPPPDSCSMKLTIKEIWFSFAAPTNVRSHTHAFSRQLNLLSTATPAVGAWLVPIDQLKSSLNKLETEGTLRICAVMGCIMTEALENKSVHFPLRSKYNRLTKVARFLQENPSCLLCNILHHYLHQANYSIIDDATMSDGLPALVTLKKGLVALARQWMKFIVVTPAFKGVSLHRPAQPLKPQIAMDHEHEDGLGLDNGGGLQSDTSADGAEFEFDAATVSEHTMLLEGTANRPPPGSSGPVTGAEIMRKLSKTHTHSDSALKIKGIHPYHSLSYTSGDTATDSPVHVGRAGMPVKDSPRKESLLSYLTGSFPSLHNLLEGTPQRSSAAVKSSSLTRTGNTVATDMLSEHPLLSEPSSVSFYNWMSNAVGNRGSVLQESPVTKSGHNSLPTGVAPNLPTIPSASDFNTVLSSDQNTLDGTHSQHSTSQDDVAGVEEANQGFPAVQLADAQVVFKPLLSHTGIQSQDTMPFCYRMYFGEHLSFSGTLDCLRADIVDSDTAKERKGKRARRQGHVNLPPLEFKPALMLGTFSISAVVMEKSVCTPQNSTSALSFHDLSKRYYNTFHCNFTISCQSISQHVDMALVRLIHQFSTMIDDIKATQTDIKLSRYTAGSASPTPTFKTRKHRDFRSSDFSRSSRGSLNGGNRVNNAKNKRTNNENNKKESRNKNSLGRSERRTSKVSRKGSKDVVDHMTIHMDDSDSITVSEQSEPSAECWQNMYKLLNFYSLISDPTGILEKSSETFGPAGVRSPTEPTCKVVFENEQDNSSLTKTQRKRSLVTSEPQHVTLIVFGIGMVNRTHLEADIGGLTMESELKRIHGSFTLKEKMKDVLHQKMTETCATAHIGGVNIVLLEGITPNIQLEDFPTSPTSTAKQEFLTVVKCSIAKSQALYSAQRGLKTNNAAVFKVGAISINIPQHPATLHSMMVRSSHQLSKQISDLIRQPSTAPQPVKEDIATPLPSEKTPTSVNQTPVETNEFPQLPEGLEKKPIVLKFSAMLDGIAIGAALLPSLKAEYKMGRMRSHGMTGAQTRFTFELPNHRLRFTSKVSATDMSTIPPSASLNLPPVTMSGKYIMEEHDSYSDQVWSIDELPSKQGYYLQGNYLRCVAEVGSFEHNLTTDLLNHLVFVQKVFMKEVNEVIQKVSGGEQPIPLWNEHDGTADGDKPKILLYSLNLQFKGIQVTATTPSMRAVRFETGLIELELSNRLQTKASPGSSSYLKLFGKCQVDLNLALGQIVKHQVYEEAGSDFHQVAYFKTRIGLRNALREEISGSSDREAVLITLNRPIVYAQPVAFDRAVLFWLNYKAAYDNWNEQRMALHKDIHMATKEVVDMLPGIQQTSAQAFGTLFLQLTVNDLGICLPITNTAQSNHTGDLDTGSALVLTIESTLITACSSESLVSKGHFKNFCIRFADGFETSWDDWKPEIHGDLVMNACVVPDGTYEVCSRTTGQAAAESSSAGTWTLNVLWKMCGIDVHMDPNIGKRLNALGNTLTTLTGEEDIDDIADLNSVNIADLSDEDEVDTMSPTIHTEATDYRRQAASASQPGELRGRKIMKRIVDIRELNEQAKVIDDLKKLGASEGTINQEIQRYQQLESVAVNDIRRDVRKKLRRSSMRAASLKDKWGLSYKPSYSRSKSISASGRPPLKRMERASSRVGETEELPEIRVDAASPGPRVTFNIQDTFPEETELDLLSVTIEGPSHYSSNSEGSCSVFSSPKTPGGFSPGIPFQTEEGRRDDSLSSTSEDSEKDEKDEDHERERFYIYRKPSHTSRKKATGFAAVHQLFTERWPTTPVNRSLSGTATERNIDFELDIRVEIDSGKCVLHPTTLLQEHDDISLRRSYDRSSRSLDQDSPSKKKKFQTNYASTTHLMTGKKVPSSLQTKPSDLETTVFYIPGVDVKLHYNSKTLKTESPNASRGSSLPRTLSKESKLYGMKDSATSPPSPPLPSTVQSKTNTLLPPQPPPIPAAKGKGSGGVKTAKLYAWVALQSLPEEMVISPCLLDFLEKALETIPITPVERNYTAVSSQDEDMGHFEIPDPMEESTTSLVSSSTSAYSSFPVDVVVYVRVQPSQIKFSCLPVSRVECMLKLPSLDLVFSSNRGELETLGTTYPAETLSPGGNATQSGTKTSASKTGIPGSSGLGSPLGRSRHSSSQSDLTSSSSSSSGLSFTACMSDFSLYVFHPYGAGKQKTAVSGLTPGSGGLGNVDEEPTSVTGRKDSLSINLEFVKVSLSRIRRSGGASFFESQSVSKSASKMDTTLINISAVCDIGSASFKYDMRRLSEILAFPRAWYRRSIARRLFLGDQTINLPTSGPGTPDSIEGVSQHLSPESSRKAYCKTWEQPSQSASFTHMPQSPNVFNEHMTNSTMSPGTVGQSLKSPASIRSRSVSDSSVPRRDSLSKTSTPFNKSNKAASQQGTPWETLVVFAINLKQLNVQMNMSNVMGNTTWTTSGLKSQGRLSVGSNRDREISMSVGLGRSQLDSKGGVVGGTIDVNALEMVAHISEHPNQQPSHKIQITMGSTEARVDYMGSSILMGIFSNADLKLQDEWKVNLYNTLDSSITDKSEIFVHGDLKWDIFQVMISRSTTPDLIKIGMKLQEFFTQQFDTSKRALSTWGPVPYLPPKTMTSNLEKSSQEQLLDAAHHRHWPGVLKVVSGCHISLFQIPLPEDGMQFGGSMSLHGNHMTLACFHGPNFRSKSWALFHLEEPNIAFWTEAQKIWEDGSSDHSTYIVQTLDFHLGHNTMVTKPCGALESPMATITKITRRRHENPPHGVASVKEWFNYVTATRNEELNLLRNVDANNTENSTTVKNSSLLSGFRGGSSYNHETETIFALPRMQLDFKSIHVQEPQEPSLQDASLKPKVECSVVTEFTDHICVTMDAELIMFLHDLVSAYLKEKEKAIFPPRILSTRPGQKSPIIIHDDNSSDKDREDSITYTTVDWRDFMCNTWHLEPTLRLISWTGRKIDPVGVDYILQKLGFHHARTTIPKWLQRGVMDPLDKVLSVLIKKLGTALQDEKEKKGKDKEEH

SEQ ID NO: 1341 - protein, 483 aa, Human
MSIRVTQKSYKVSTSGPRAFSSRSYTSGPGSRISSSSFSRVGSSNFRGGLGGGYGGASGMGGITAVTVNQSLLSPLVLEVDPNIQAVRTQEKEQIKTLNNKFASFIDKVRFLEQQNKMLETKWSLLQQQKTARSNMDNMFESYINNLRRQLETLGQEKLKLEAELGNMQGLVEDFKNKYEDEINKRTEMENEFVLIKKDVDEAYMNKVELESRLEGLTDEINFLRQLYEEEIRELQSQISDTSVVLSMDNSRSLDMDSIIAEVKAQYEDIANRSRAEAESMYQIKYEELQSLAGKHGDDLRRTKTEISEMNRNISRLQAEIEGLKGQRASLEAAIADAEQRGELAIKDANAKLSELEAALQRAKQDMARQLREYQELMNVKLALDIEIATYRKLLEGEESRLESGMQNMSIHTKTTSGYAGGLSSAYGGLTSPGLSYSLGSSFGSGAGSSSFSRTSSSRAVVVKKIETRDGKLVSESSDVLPK

SEQ ID NO: 1342 - protein, 1019 aa, Human
MLWRVLLSKRPPFPHPELDFQEAPIPSCPGRLPGRKNSVALAAAPRKEPTGDREKPLPFPVLAPFSNPEHSAPAKVVRAAVPKQRKGSKVGDFGDAINWPTPGEIAHKSVQPQSHKPQPTRKLPPKKDMKEQEKGEGSDSKESPKTKSDESGEEKNGDEDCQRGGQKKKGNKHKWVPLQIDMKPEVPREKLASRPTRPPEPRHIPANRGEIKGSESATYVPVAPPTPAWQPEIKPEPAWHDQDETSSVKSDGAGGARASFRGRGRGRGRGRGRGRGGTRTHFDYQFGYRKFDGVEGPRTPKYMNNITYYFDNVSSTELYSVDQELLKDYIKRQIEYYFSVDNLERDFFLRRKMDADGFLPITLIASFHRVQALTTDISLIFAALKDSKVVEIVDEKVRRREEPEKWPLPPIVDYSQTDFSQLLNCPEFVPRQHYQKETESAPGSPRAVTPVPTKTEEVSNLKTLPKGLSASLPDLDSENWIEVKKRPRPSPARPKKSEESRFSHLTSLPQQLPSQQLMSKDQDEQEELDFLFDEEMEQMDGRKNTFTAWSDEESDYEIDDRDVNKILIVTQTPHYMRRHPGGDRTGNHTSRAKMSAELAKVINDGLFYYEQDLWAEKFEPEYSQIKQEVENFKKVNMISREQFDTLTPEPPVDPNQEVPPGPPRFQQVPTDALANKLFGAPEPSTIARSLPTTVPESPNYRNTRTPRTPRTPQLKDSSQTSRFYPVVKEGRTLDAKMPRKRKTRHSSNPPLESHVGWVMDSREHRPRTASISSSPSEGTPTVGSYGCTPQSLPKFQHPSHELLKENGFTQHVYHKYRRRCLNERKRLGIGQSQEMNTLFRFWSFFLRDHFNKKMYEEFKQLALEDAKEGYRYGLECLFRYYSYGLEKKFRLDIFKDFQEETVKDYEAGQLYGLEKFWAFLKYSKAKNLDIDPKLQEYLGKFRRLEDFRVDPPMGEEGNHKRHSVVAGGGGGEGRKRCPSQSSSRPAAMISQPPTPPTGQPVREDAKWTSQHSNTQTLGK

SEQ ID NO: 1343 - protein, 586 aa, Human
MATATPVPPRMGSRAGGPTTPLSPTRLSRLQEKEELRELNDRLAVYIDKVRSLETENSALQLQVTEREEVRGRELTGLKALYETELADARRALDDTARERAKLQIELGKCKAEHDQLLLNYAKKESDLNGAQIKLREYEAALNSKDAALATALGDKKSLEGDLEDLKDQIAQLEASLAAAKKQLADETLLKVDLENRCQSLTEDLEFRKSMYEEEINETRRKHETRLVEVDSGRQIEYEYKLAQALHEMREQHDAQVRLYKEELEQTYHAKLENARLSSEMNTSTVNSAREELMESRMRIESLSSQLSNLQKESRACLERIQELEDLLAKEKDNSRRMLTDKEREMAEIRDQMQQQLNDYEQLLDVKLALDMEISAYRKLLEGEEERLKLSPSPSSRVTVSRASSSRSVRTTRGKRKRVDVEESEASSSVSISHSASATGNVCIEEIDVDGKFIRLKNTSEQDQPMGGWEMIRKIGDTSVSYKYTSRYVLKAGQTVTIWAANAGVTASPPTDLIWKNQNSWGTGEDVKVILKNSQGEEVAQRSTVFKTTIPEEEEEEEEAAGVVVEEELFHQQGTPRASNRSCAIM

SEQ ID NO: 1344 - protein, 534 aa, Human
MRLRGCGPRAAPASSAGASDARLLAPPGRNPFVHELRLSALQKAQVALMTLTLFPVRLLVAAAMMLLAWPLALVASLGSAEKEPEQPPALWRKVVDFLLKAIMRTMWFAGGFHRVAVKGRQALPTEAAILTLAPHSSYFDAIPVTMTMSSIVMKAESRDIPIWGTLIQYIRPVFVSRSDQDSRRKTVEEIKRRAQSNGKWPQIMIFPEGTCTNRTCLITFKPGAFIPGAPVQPVVLRYPNKLDTITWTWQGPGALEILWLTLCQFHNQVEIEFLPVYSPSEEEKRNPALYASNVRRVMAEALGVSVTDYTFEDCQLALAEGQLRLPADTCLLEFARLVRGLGLKPEKLEKDLDRYSERARMKGGEKIGIAEFAASLEVPVSDLLEDMFSLFDESGSGEVDLRECVVALSVVCRPARTLDTIQLAFKMYGAQEDGSVGEGDLSCILKTALGVAELTVTDLFRAIDQEEKGKITFADFHRFAEMYPAFAEEYLYPDQTHFESCAETSPAPIPNGFCADFSPENSDAGRKPVRKKLD

SEQ ID NO: 1345 - protein, 606 aa, Human
MSDTSESGAGLTRFQAEASEKDSSSMMQTLLTVTQNVEVPETPKASKALEVSEDVKVSKASGVSKATEVSKTPEAREAPATQASSTTQLTDTQVLAAENKSLAADTKKQNADPQAVTMPATETKKVSHVADTKVNTKAQETEAAPSQAPADEPEPESAAAQSQENQDTRPKVKAKKARKVKHLDGEEDGSSDQSQASGTTGGRRVSKALMASMARRASRGPIAFWARRASRTRLAAWARRALLSLRSPKARRGKARRRAAKLQSSQEPEAPPPRDVALLQGRANDLVKYLLAKDQTKIPIKRSDMLKDIIKEYTDVYPEIIERAGYSLEKVFGIQLKEIDKNDHLYILLSTLEPTDAGILGTTKDSPKLGLLMVLLSIIFMNGNRSSEAVIWEVLRKLGLRPGIHHSLFGDVKKLITDEFVKQKYLDYARVPNSNPPEYEFFWGLRSYYETSKMKVLKFACKVQKKDPKEWAAQYREAMEADLKAAAEAAAEAKARAEIRARMGIGLGSENAAGPCNWDEADIGPWAKARIQAGAEAKAKAQESGSASTGASTSTNNSASASASTSGGFSAGASLTATLTFGLFAGLGGAGASTSGSSGACGFSYK

SEQ ID NO: 1346 - protein, 813 aa, Human
DPETPSDAAAMESGPRAELGAGAPPAVVARTPPEPRPSPEGDPSPPPPPMSALVPDTPPDTPPAMKNATSSKQLPLEPESPSGQVGPRPAPPQEESPSSEAKSRGPTPPAMGPRDARPPRRSSQPSPTAVPASDSPPTKQEVKKAGERHKLAKERREERAKYLAAKKAVWLEKEEKAKALREKQLQERRRRLEEQRLKAEQRRAALEERQRQKLEKNKERYEAAIQRSVKKTWAEIRQQRWSWAGALHHSSPGHKTNRSLQLSAWESSIVDRLMTPTLSFLARSRSAVTLPRNGRDQGRGCDPGRGPTWGRAGASLARGPQPDRTHPSAAVPVCPRSASASPLTPCSVTRSVHRCAPAGERGERRKPNAGGSPAPVRRRPEASPVQKKEKKDKERENEKEKSALARERSLKKRQSLPASPRARLSASTASELSPKSKARPSSPSTSWHRPASPCPSPGPGHTLPPKPPSPRGTTASPKGRVRRKEEAKESPSAAGPEDKSQSKRRASNEKESAAPASPAPSPAPSPTPAPPQKEQPPAETPTDAAVLTSPPAPAPPVTPSKPMAGTTDREEATRLLAEKRRQAREQREREEQERRLQAERDKRMREEQLAREAEARAEREAEARRREEQEAREKAQAEQEEQERLQKQKEEAEARSREEAERQRLEREKHFQQQEQERQERRKRLEEIMKRTRKSEVSETKKQDSKEANANGSSPEPVKAVEARSPGLQKEAVQKEEPIPQEPQWSLPSKELPASLVNGLQPLPAHQENGFSTNGPSGDKSLSRTPETLLPFAEAEAFLKKAVVQSPQVTEVL

SEQ ID NO: 1347 - protein, 426 aa, Human
MSKSKVDNQFYSVEVGDSTFTVLKRYQNLKPIGSGAQGIVCAAYDAVLDRNVAIKKLSRPFQNQTHAKRAYRELVLMKCVNHKNIISLLNVFTPQKTLEEFQDVYLVMELMDANLCQVIQMELDHERMSYLLYQMLCGIKHLHSAGIIHRDLKPSNIVVKSDCTLKILDFGLARTAGTSFMMTPYVVTRYYRAPEVILGMGYKENVDIWSVGCIMGEMVRHKILFPGRDYIDQWNKVIEQLGTPCPEFMKKLQPTVRNYVENRPKYAGLTFPKLFPDSLFPADSEHNKLKASQARDLLSKMLVIDPAKRISVDDALQHPYINVWYDPAEVEAPPPQIYDKQLDEREHTIEEWKELIYKEVMNSEEKTKNGVVKGQPSPSGAAVNSSESLPPSSSVNDISSMSTDQTLASDTDSSLEASAGPLGCCR

SEQ ID NO: 1348 - protein, 268 aa, Human
MAVNVYSTSVTSDNLSRHDMLAWINESLQLNLTKIEQLCSGAAYCQFMDMLFPGSIALKKVKFQAKLEHEYIQNFKILQAGFKRMGVDKIIPVDKLVKGKFQDNFEFVQWFKKFFDANYDGKDYDPVAARQGQETAVAPSLVAPALNKPKKPLTSSSAAPQRPISTQRTAAAPKAGPGVVRKNPGVGNGDDEAAELMQQVNVLKLTVEDLEKERDFYFGKLRNIELICQENEGENDPVLQRIVDILYATDEGFVIPDEGGPQEEQEEY

SEQ ID NO: 1349 - protein, 352 aa, Human
MAEPRQEFEVMEDHAGTYGLGDRKDQGGYTMHQDQEGDTDAGLKAEEAGIGDTPSLEDEAAGHVTQARMVSKSKDGTGSDDKKAKGADGKTKIATPRGAAPPGQKGQANATRIPAKTPPAPKTPPSSGEPPKSGDRSGYSSPGSPGTPGSRSRTPSLPTPPTREPKKVAVVRTPPKSPSSAKSRLQTAPVPMPDLKNVKSKIGSTENLKHQPGGGKVQIVYKPVDLSKVTSKCGSLGNIHHKPGGGQVEVKSEKLDFKDRVQSKIGSLDNITHVPGGGNKKIETHKLTFRENAKAKTDHGAEIVYKSPVVSGDTSPRHLSNVSSTGSIDMVDSPQLATLADEVSASLAKQGL

SEQ ID NO: 1350 - protein, 1798 aa, Human
MKRSRCRDRPQPPPPDRREDGVQRAAELSQSLPPRRRAPPGRQRLEERTGPAGPEGKEQDVVTGVSPLLFRKLSNPDIFSSTGKVKLQRQLSQDDCKLWRGNLASSLSGKQLLPLSSSVHSSVGQVTWQSSGEASNLVRMRNQSLGQSAPSLTAGLKELSLPRRGSFCRTSNRKSLIVTSSTSPTLPRPHSPLHGHTGNSPLDSPRNFSPNAPAHFSFVPARRTDGRRWSLASLPSSGYGTNTPSSTVSSSCSSQEKLHQLPFQPTADELHFLTKHFSTESVPDEEGRQSPAMRPRSRSLSPGRSPVSFDSEIIMMNHVYKERFPKATAQMEERLAEFISSNTPDSVLPLADGALSFIHHQVIEMARDCLDKSRSGLITSQYFYELQDNLEKLLQDAHERSESSEVAFVMQLVKKLMIIIARPARLLECLEFDPEEFYHLLEAAEGHAKEGQGIKCDIPRYIVSQLGLTRDPLEEMAQLSSCDSPDTPETDDSIEGHGASLPSKKTPSEEDFETIKLISNGAYGAVFLVRHKSTRQRFAMKKINKQNLILRNQIQQAFVERDILTFAENPFVVSMFCSFDTKRHLCMVMEYVEGGDCATLLKNIGALPVDMVRLYFAETVLALEYLHNYGIVHRDLKPDNLLITSMGHIKLTDFGLSKIGLMSLTTNLYEGHIEKDAREFLDKQVCGTPEYIAPEVILRQGYGKPVDWWAMGIILYEFLVGCVPFFGDTPEELFGQVISDEIVWPEGDEALPPDAQDLTSKLLHQNPLERLGTGSAYEVKQHPFFTGLDWTGLLRQKAEFIPQLESEDDTSYFDTRSERYHHMDSEDEEEVSEDGCLEIRQFSSCSPRFNKVYSSMERLSLLEERRTPPPTKRSLSEEKEDHSDGLAGLKGRDRSWVIGSPEILRKRLSVSESSHTESDSSPPMTVRRRCSGLLDAPRFPEGPEEASSTLRRQPQEGIWVLTPPSGEGVSGPVTEHSGEQRPKLDEEAVGRSSGSSPAMETRGRGTSQLAEGATAKAISDLAVRRARHRLLSGDSTEKRTARPVNKVIKSASATALSLLIPSEHHTCSPLASPMSPHSQSSNPSSRDSSPSRDFLPALGSMRPPIIIHRAGKKYGFTLRAIRVYMGDSDVYTVHHMVWHVEDGGPASEAGLRQGDLITHVNGEPVHGLVHTEVVELILKSGNKVAISTTPLENTSIKVGPARKGSYKAKMARRSKRSRGKDGQESRKRSSLFRKITKQASLLHTSRSLSSLNRSLSSGESGPGSPTHSHSLSPRSPTQGYRVTPDAVHSVGGNSSQSSSPSSSVPSSPAGSGHTRPSSLHGLAPKLQRQYRSPRRKSAGSIPLSPLAHTPSPPPPTASPQRSPSPLSGHVAQAFPTKLHLSPPLGRQLSRPKSAEPPRSPLLKRVQSAEKLAAALAASEKKLATSRKHSLDLPHSELKKELPPREVSPLEVVGARSVLSGKGALPGKGVLQPAPSRALGTLRQDRAERRESLQKQEAIREVDSSEDDTEEGPENSQGAQELSLAPHPEVSQSVAPKGAGESGEEDPFPSRDPRSLGPMVPSLLTGITLGPPRMESPSGPHRRLGSPQAIEEAASSSSAGPNLGQSGATDPIPPEGCWKAQHLHTQALTALSPSTSGLTPTSSCSPPSSTSGKLSMWSWKSLIEGPDRASPSRKATMAGGLANLQDLENTTPAQPKNLSPREQGKTQPPSAPRLAHPSYEDPSQGWLWESECAQAVKEDPALSITQVPDASGDRRQDVPCRGCPLTQKSEPSLRRGQEPGGHQKHRDLALVPDELLKQT

SEQ ID NO: 1351 - protein, 291 aa, Human
MERKRWECPALPQGWEREEVPRRSGLSAGHRDVFYYSPSGKKFRSKPQLARYLGGSMDLSTFDFRTGKMLMSKMNKSRQRVRYDSSNQVKGKPDLNTALPVRQTASIFKQPVTKITNHPSNKVKSDPQKAVDQPRQLFWEKKLSGLNAFDIAEELVKTMDLPKGLQGVGPGCTDETLLSAIASALHTSTMPITGQLSAAVEKNPGVWLNTTQPLCKAFMVTDEDIRKQEELVQQVRKRLEEALMADMLAHVEELARDGEAPLDKACAEDDDEEDEEEEEEEPDPDPEMEHV

SEQ ID NO: 1352 - protein, 725 aa, Human
MAAASAVSVLLVAAERNRWHRLPSLLLPPRTWVWRQRTMKYTTATGRNITKVLIANRGEIACRVMRTAKKLGVQTVAVYSEADRNSMHVDMADEAYSIGPAPSQQSYLSMEKIIQVAKTSAAQAIHPGCGFLSENMEFAELCKQEGIIFIGPPPSAIRDMGIKSTSKSIMAAAGVPVVEGYHGEDQSDQCLKEHARRIGYPVMIKAVRGGGGKGMRIVRSEQEFQEQLESARREAKKSFNDDAMLIEKFVDTPRHVEVQVFGDHHGNAVYLFERDCSVQRRHQKIIEEAPAPGIKSEVRKKLGEAAVRAAKAVNYVGAGTVEFIMDSKHNFCFMEMNTRLQVEHPVTEMITGTDLVEWQLRIAAGEKIPLSQEEITLQGHAFEARIYAEDPSNNFMPVAGPLVHLSTPRADPSTRIETGVRQGDEVSVHYDPMIAKLVVWAADRQAALTKLRYSLRQYNIVGLHTNIDFLLNLSGHPEFEAGNVHTDFIPQHHKQLLLSRKAAAKESLCQAALGLILKEKAMTDTFTLQAHDQFSPFSSSSGRRLNISYTRNMTLKDGKNNVAIAVTYNHDGSYSMQIEDKTFQVLGNLYSEGDCTYLKCSVNGVASKAKLIILENTIYLFSKEGSIEIDIPVPKYLSSVSSQETQGGPLAPMTGTIEKVFVKAGDKVKAGDSLMVMIAMKMEHTIKSPKDGTVKKVFYREGAQANRHTPLVEFEEEESDKRESE

SEQ ID NO: 1353 - protein, 1541 aa, Human
MSFLEEARAAGRAVVLALVLLLLPAVPVGASVPPRPLLPLQPGMPHVCAEQELTLVGRRQPCVQALSHTVPVWKAGCGWQAWCVGHERRTVYYMGYRQVYTTEARTVLRCCRGWMQQPDEEGCLSAECSASLCFHGGRCVPGSAQPCHCPPGFQGPRCQYDVDECRTHNGGCQHRCVNTPGSYLCECKPGFRLHTDSRTCLAINSCALGNGGCQHHCVQLTITRHRCQCRPGFQLQEDGRHCVRRSPCANRNGSCMHRCQVVRGLARCECHVGYQLAADGKACEDVDECAAGLAQCAHGCLNTQGSFKCVCHAGYELGADGRQCYRIEMEIVNSCEANNGGCSHGCSHTSAGPLCTCPRGYELDTDQRTCIDVDDCADSPCCQQVCTNNPGGYECGCYAGYRLSADGCGCEDVDECASSRGGCEHHCTNLAGSFQCSCEAGYRLHEDRRGCSPLEEPMVDLDGELPFVRPLPHIAVLQDELPQLFQDDDVGADEEEAELRGEHTLTEKFVCLDDSFGHDCSLTCDDCRNGGTCLLGLDGCDCPEGWTGLICNETCPPDTFGKNCSFSCSCQNGGTCDSVTGACRCPPGVSGTNCEDGCPKGYYGKHCRKKCNCANRGRCHRLYGACLCDPGLYGRFCHLTCPPWAFGPGCSEECQCVQPHTQSCDKRDGSCSCKAGFRGERCQAECELGYFGPGCWQACTCPVGVACDSVSGECGKRCPAGFQGEDCGQECPVGTFGVNCSSSCSCGGAPCHGVTGQCRCPPGRTGEDCEADCPEGRWGLGCQEICPACQHAARCDPETGACLCLPGFVGSRCQDVCPAGWYGPSCQTRCSCANDGHCHPATGHCSCAPGWTGFSCQRACDTGHWGPDCSHPCNCSAGHGSCDAISGLCLCEAGYVGPRCEQQCPQGHFGPGCEQRCQCQHGAACDHVSGACTCPAGWRGTFCEHACPAGFFGLDCRSACNCTAGAACDAVNGSCLCPAGRRGPRCAETCPAHTYGHNCSQACACFNGASCDPVHGQCHCAPGWMGPSCLQACPAGLYGDNCRHSCLCQNGGTCDPVSGHCACPEGWAGLACEKECLPRDVRAGCRHSGGCLNGGLCDPHTGRCLCPAGWTGDKCQSPCLRGWFGEACAQRCSCPPGAACHHVTGACRCPPGFTGSGCEQACPPGSFGEDCAQMCQCPGENPACHPATGTCSCAAGYHGPSCQQRCPPGRYGPGCEQLCGCLNGGSCDAATGACRCPTGFLGTDCNLTCPQGRFGPNCTHVCGCGQGAACDPVTGTCLCPPGRAGVRCERGCPQNRFGVGCEHTCSCRNGGLCHASNGSCSCGLGWTGRHCELACPPGRYGAACHLECSCHNNSTCEPATGTCRCGPGFYGQACEHPCPPGFHGAGCQGLCWCQHGAPCDPISGRCLCPAGFHGHFCERGCEPGSFGEGCHQRCDCDGGAPCDPVTGLCLCPPGRSGATCNLDCRRGQFGPSCTLHCDCGGGADCDPVSGQCHCVDGYMGPTCREGGPLRLPENPSLAQGSAGTLPASSRPTSRSGGPARH

SEQ ID NO: 1354 - protein, 1093 aa, Human
MKEMVGGCCVCSDERGWAENPLVYCDGHACSVAVHQACYGIVQVPTGPWFCRKCESQERAARVRCELCPHKDGALKRTDNGGWAHVVCALYIPEVQFANVLTMEPIVLQYVPHDRFNKTCYICEEQGRESKAASGACMTCNRHGCRQAFHVTCAQMAGLLCEEEVLEVDNVKYCGYCKYHFSKMKTSRHSSGGGGGGAGGGGGSMGGGGSGFISGRRSRSASPSTQQEKHPTHHERGQKKSRKDKERLKQKHKKRPESPPSILTPPVVPTADKVSSSASSSSHHEASTQETSESSRESKGKKSSSHSLSHKGKKLSSGKGVSSFTSASSSSSSSSSSSGGPFQPAVSSLQSSPDFSAFPKLEQPEEDKYSKPTAPAPSAPPSPSAPEPPKADLFEQKVVFSGFGPIMRFSTTTSSSGRARAPSPGDYKSPHVTGSGASAGTHKRMPALSATPVPADETPETGLKEKKHKASKRSRHGPGRPKGSRNKEGTGGPAAPSLPSAQLAGFTATAASPFSGGSLVSSGLGGLSSRTFGPSGSLPSLSLESPLLGAGIYTSNKDPISHSGGMLRAVCSTPLSSSLLGPPGTSALPRLSRSPFTSTLPSSSASISTTQVFSLAGSTFSLPSTHIFGTPMGAVNPLLSQAESSHTEPDLEDCSFRCRGTSPQESLSSMSPISSLPALFDQTASAPCGGGQLDPAAPGTTNMEQLLEKQGDGEAGVNIVEMLKALHALQKENQRLQEQILSLTAKKERLQILNVQLSVPFPALPAALPAANGPVPGPYGLPPQAGSSDSLSTSKSPPGKSSLGLDNSLSTSSEDPHSGCPSRSSSSLSFHSTPPPLPLLQQSPATLPLALPGAPAPLPPQPQNGLGRAPGAAGLGAMPMAEGLLGGLAGSGGLPLNGLLGGLNGAAAPNPASLSQAGGAPTLQLPGCLNSLTEQQRHLLQQQEQQLQQLQQLLASPQLTPEHQTVVYQMIQQIQQKRELQRLQMAGGSQLPMASLLAGSSTPLLSAGTPGLLPTASAPPLLPAGALVAPSLGNNTSLMAAAAAAAAVAAAGGPPVLTAQTNPFLSLSGAEGSGGGPKGGTADKGASANQEKG

SEQ ID NO: 1355 - protein, 160 aa, Human
MAAERKTRLSKNLLRMKFMQRGLDSETKKQLEEEEKKIISEEHWYLDLPELKEKESFIIEEQSFLLCEDLLYGRMSFRGFNPEVEKLMLQMNAKHKAEEVEDETVELDVSDEEMARRYETLVGTIGKKFARKRDHANYEEDENGDITPIKAKKMFLKPQD

SEQ ID NO: 1356 - protein, 395 aa, Human
MFPRVSTFLPLRPLSRHPLSSGSPETSAAAIMLLTVRHGTVRYRSSALLARTKNNIQRYFGTNSVICSKKDKQSVRTEETSKETSESQDSEKENTKKDLLGIIKGMKVELSTVNVRTTKPPKRRPLKSLEATLGRLRRATEYAPKKRIEPLSPELVAAASAVADSLPFDKQTTKSELLSQLQQHEEESRAQRDAKRPKISFSNIISDMKVARSATARVRSRPELRIQFDEGYDNYPGQEKTDDLKKRKNIFTGKRLNIFDMMAVTKEAPETDTSPSLWDVEFAKQLATVNEQPLQNGFEELIQWTKEGKLWEFPINNEAGFDDDGSEFHEHIFLEKHLESFPKQGPIRHFMELVTCGLSKNPYLSVKQKVEHIEWFRNYFNEKKDILKESNIQFN

SEQ ID NO: 1357 - protein, 711 aa, Human
MMADAKYVLCRWEKRLWPAKVLARTATSTKNKRRKEYFLAVQILSLEEKIKVKSTEVEILEKSQIEAIASSLASQNEVPAAPLEELAYRRSLRVALDVLSEGSIWSQESSAGTGRADRSLRGKPMEHVSSPCDSNSSSLPRGDVLGSSRPHRRRPCVQQSLSSSFTCEKDPECKVDHKKGLRKSENPRGPLVLPAGGGAQDESGSRIHHKNWTLASKRGGNSAQKASLCLNGSSLSEDDTERDMGSKGGSWAAPSLPSGVREDDPCANAEGHDPGLPLGSLTAPPAPEPSACSEPGECPAKKRPRLDGSQRPPAVQLEPMAAGAAPSPGPGPGPRESVTPRSTARLGPPPSHASADATRCLPCPDSQKLEKECQSSEESMGSNSMRSILEEDEEDEEPPRVLLYHEPRSFEVGMLVWHKHKKYPFWPAVVKSVRQRDKKASVLYIEGHMNPKMKGFTVSLKSLKHFDCKEKQTLLNQAREDFNQDIGWCVSLITDYRVRLGCGSFAGSFLEYYAADISYPVRKSIQQDVLGTKLPQLSKGSPEEPVVGCPLGQRQPCRKMLPDRSRAARDRANQKLVEYIVKAKGAESHLRAILKSRKPSRWLQTFLSSSQYVTCVETYLEDEGQLDLVVKYLQGVYQEVGAKVLQRTNGDRIRFILDVLLPEAIICAISAVDEVDYKTAEEKYIKGPSLSYREKEIFDNQLLEERNRRRR

SEQ ID NO: 1358 - protein, 578 aa, Human
SVLEALSGVALPRGSGIVTRCPLVLKLKKLVNEDKWRGKVSYQDYEIEISDASEVEKEINKAQNAIAGEGMGISHELITLEISSRDVPDLTLIDLPGITRVAVGNQPADIGYKIKTLIKKYIQRQETISLVVVPSNVDIATTEALSMAQEVDPEGDRTIGILTKPDLVDKGTEDKVVDVVRNLVFHLKKGYMIVKCRGQQEIQDQLSLSEALQREKIFFENHPYFRDLLEEGKATVPCLAEKLTSELITHICKSLPLLENQIKETHQRITEELQKYGVDIPEDENEKMFFLIDKINAFNQDITALMQGEETVGEEDIRLFTRLRHEFHKWSTIIENNFQEGHKILSRKIQKFENQYRGRELPGFVNYRTFETIVKQQIKALEEPAVDMLHTVTDMVRLAFTDVSIKNFEEFFNLHRTAKSKIEDIRAEQEREGEKLIRLHFQMEQIVYCQDQVYRGALQKVREKELEEEKKKKSWDFGAFQSSSATDSSMEEIFQHLMAYHQEASKRISSHIPLIIQFFMLQTYGQQLQKAMLQLLQDKDTYSWLLKERSDTSDKRKFLKERLARLTQARRRLAQFPG

SEQ ID NO: 1359 - protein, 172 aa, Human
MPDSWDKDVYPEPPRRTPVQPNPIVYMMKAFDLIVDRPVTLVREFIERQHAKNRYYYYHRQYRRVPDITECKEEDIMCMYEAEMQWKRDYKVDQEIINIMQDRLKACQQREGQNYQQNCIKEVEQFTQVAKAYQDRYQDLGAYSSARKCLAKQRQRMLQERKAAKEAAAATS

SEQ ID NO: 1360 - protein, 1378 aa, Human
MSLERELRQLSKAKAKAQRAGQRREEAALCHQLGELLAGHGRYAEALEQHWQELQLRERADDPLGCAVAHRKIGERLAEMEDYPAALQHQHQYLELAHSLRNHTELQRAWATIGRTHLDIYDHCQSRDALLQAQAAFEKSLAIVDEELEGTLAQGELNEMRTRLYLNLGLTFESLQQTALCNDYFRKSIFLAEQNHLYEDLFRARYNLGTIHWRAGQHSQAMRCLEGARECAHTMRKRFMESECCVVIAQVLQDLGDFLAAKRALKKAYRLGSQKPVQRAAICQNLQHVLAVVRLQQQLEEAEGRDPQGAMVICEQLGDLFSKAGDFPRAAEAYQKQLRFAELLDRPGAERAIIHVSLATTLGDMKDHHGAVRHYEEELRLRSGNVLEEAKTWLNIALSREEAGDAYELLAPCFQKALSCAQQAQRPQLQRQVLQHLHTVQLRLQPQEAPETETRLRELSVAEDEDEEEEAEEAAATAESEALEAGEVELSEGEDDTDGLTPQLEEDEELQGHLGRRKGSKWNRRNDMGETLLHRACIEGQLRRVQDLVRQGHPLNPRDYCGWTPLHEACNYGHLEIVRFLLDHGAAVDDPGGQGCEGITPLHDALNCGHFEVAELLLERGASVTLRTRKGLSPLETLQQWVKLYRRDLDLETRQKARAMEMLLQAAASGQDPHSSQAFHTPSSLLFDPETSPPLSPCPEPPSNSTRLPEASQAHVRVSPGQAAPAMARPRRSRHGPASSSSSSEGEDSAGPARPSQKRPRCSATAQRVAAWTPGPASNREAATASTSRAAYQAAIRGVGSAQSRLGPGPPRGHSKALAPQAALIPEEECLAGDWLELDMPLTRSRRPRPRGTGDNRRPSSTSGSDSEESRPRARAKQVRLTCMQSCSAPVNAGPSSLASEPPGSPSTPRVSEPSGDSSAAGQPLGPAPPPPIRVRVQVQDHLFLIPVPHSSDTHSVAWLAEQAAQRYYQTCGLLPRLTLRKEGALLAPQDLIPDVLQSNDEVLAEVTSWDLPPLTDRYRRACQSLGQGEHQQVLQAVELQGLGLSFSACSLALDQAQLTPLLRALKLHTALRELRLAGNRLGDKCVAELVAALGTMPSLALLDLSSNHLGPEGLRQLAMGLPGQATLQSLEELDLSMNPLGDGCGQSLASLLHACPLLSTLRLQACGFGPSFFLSHQTALGSAFQDAEHLKTLSLSYNALGAPALARTLQSLPAGTLLHLELSSVAAGKGDSDLMEPVFRYLAKEGCALAHLTLSANHLGDKAVRDLCRCLSLCPSLISLDLSANPEISCASLEELLSTLQKRPQGLSFLGLSGCAVQGPLGLGLWDKIAAQLRELQLCSRRLCAEDRDALRQLQPSRPGPGECTLDHGSKLFFRRL

SEQ ID NO: 1361 - protein, 1504 aa, Human
MATARTFGPEREAEPAKEARVVGSELVDTYTVYIIQVTDGSHEWTVKHRYSDFHDLHEKLVAERKIDKNLLPPKKIIGKNSRSLVEKREKDLEVYLQKLLAAFPGVTPRVLAHFLHFHFYEINGITAALAEELFEKGEQLLGAGEVFAIGPLQLYAVTEQLQQGKPTCASGDAKTDLGHILDFTCRLKYLKVSGTEGPFGTSNIQEQLLPFDLSIFKSLHQVEISHCDAKHIRGLVASKPTLATLSVRFSATSMKEVLVPEASEFDEWEPEGTTLEGPVTAVIPTWQALTTLDLSHNSISEIDESVKLIPKIEFLDLSHNGLLVVDNLQHLYNLVHLDLSYNKLSSLEGLHTKLGNIKTLNLAGNLLESLSGLHKLYSLVNLDLRDNRIEQMEEVRSIGSLPCLEHVSLLNNPLSIIPDYRTKVLAQFGERASEVCLDDTVTTEKELDTVEVLKAIQKAKEVKSKLSNPEKKGGEDSRLSAAPCIRPSSSPPTVAPASASLPQPILSNQGIMFVQEEALASSLSSTDSLTPEHQPIAQGCSDSLESIPAGQAASDDLRDVPGAVGGASPEHAEPEVQVVPGSGQIIFLPFTCIGYTATNQDFIQRLSTLIRQAIERQLPAWIEAANQREEGQGEQGEEEDEEEEEEEDVAENRYFEMGPPDVEEEEGGGQGEEEEEEEEDEEAEEERLALEWALGADEDFLLEHIRILKVLWCFLIHVQGSIRQFAACLVLTDFGIAVFEIPHQESRGSSQHILSSLRFVFCFPHGDLTEFGFLMPELCLVLKVRHSENTLFIISDAANLHEFHADLRSCFAPQHMAMLCSPILYGSHTSLQEFLRQLLTFYKVAGGCQERSQGCFPVYLVYSDKRMVQTAAGDYSGNIEWASCTLCSAVRRSCCAPSEAVKSAAIPYWLLLTPQHLNVIKADFNPMPNRGTHNCRNRNSFKLSRVPLSTVLLDPTRSCTQPRGAFADGHVLELLVGYRFVTAIFVLPHEKFHFLRVYNQLRASLQDLKTVVIAKTPGTGGSPQGSFADGQPAERRASNDQRPQEVPAEALAPAPAEVPAPAPAAASASGPAKTPAPAEASTSALVPEETPVEAPAPPPAEAPAQYPSEHLIQATSEENQIPSHLPACPSLRHVASLRGSAIIELFHSSIAEVENEELRHLMWSSVVFYQTPGLEVTACVLLSTKAVYFVLHDGLRRYFSEPLQDFWHQKNTDYNNSPFHISQCFVLKLSDLQSVNVGLFDQHFRLTGSTPMQVVTCLTRDSYLTHCFLQHLMVVLSSLERTPSPEPVDKDFYSEFGNKTTGKMENYELIHSSRVKFTYPSEEEIGDLTFTVAQKMAEPEKAPALSILLYVQAFQVGMPPPGCCRGPLRPKTLLLTSSEIFLLDEDCVHYPLPEFAKEPPQRDRYRLDDGRRVRDLDRVLMGYQTYPQALTLVFDDVQGHDLMGSVTLDHFGEVPGGPARASQGREVQWQVFVPSAESREKLISLLARQWEALCGRELPVELTG

SEQ ID NO: 1362 - protein, 663 aa, Human
MIEKMQGSRMDEQRCSFPPPLKTEEDYIPYPSVHEVLGREGPFPLILLPQFGGYWIEGTNHEITSIPETEPLQSPTTKVKLECNPTARIYRKHFLGKEHFNYYSLDTALGHLVFSLKYDVIGDQEHLRLLLRTKCRTYHDVIPISCLTEFPNVVQMAKLVCEDVNVDRFYPVLYPKASRLIVTFDEHVISNNFKFGVIYQKLGQTSEEELFSTNEESPAFVEFLEFLGQKVKLQDFKGFRGGLDVTHGQTGTESVYCNFRNKEIMFHVSTKLPYTEGDAQQLQRKRHIGNDIVAVVFQDENTPFVPDMIASNFLHAYVVVQAEGGGPDGPLYKVSVTARDDVPFFGPPLPDPAVFRKGPEFQEFLLTKLINAEYACYKAEKFAKLEERTRAALLETLYEELHIHSQSMMGLGGDEDKMENGSGGGGFFESFKRVIRSRSQSMDAMGLSNKKPNTVSTSHSGSFAPNNPDLAKAAGISLIVPGKSPTRKKSGPFGSRRSSAIGIENIQEVQEKRESPPAGQKTPDSGHVSQEPKSENSSTQSSPEMPTTKNRAETAAQRAEALKDFSRSSSSASSFASVVEETEGVDGEDTGLESVSSSGTPHKRDSFIYSTWLEDSVSTTSGGSSPGPSRSPHPDAGKLGDPACPEIKIQLEASEQHMPQLGC

SEQ ID NO: 1363 - protein, 857 aa, Human
MAKAKKVGARRKASGAPAGARGGPAKANSNPFEVKVNRQKFQILGRKTRHDVGLPGVSRARALRKRTQTLLKEYKERDKSNVFRDKRFGEYNSNMSPEEKMMKRFALEQQRHHEKKSIYNLNEDEELTHYGQSLADIEKHNDIVDSDSDAEDRGTLSAELTAAHFGGGGGLLHKKTQQEGEEREKPKSRKELIEELIAKSKQEKRERQAQREDALELTEKLDQDWKEIQTLLSHKTPKSENRDKKEKPKPDAYDMMVRELGFEMKAQPSNRMKTEAELAKEEQEHLRKLEAERLRRMLGKDEDENVKKPKHMSADDLNDGFVLDKDDRRLLSYKDGKMNVEEDVQEEQSKEASDPESNEEEGDSSGGEDTEESDSPDSHLDLESNVESEEENEKPAKEQRQTPGKGLISGKERAGKATRDELPYTFAAPESYEELRSLLLGRSMEEQLLVVERIQKCNHPSLAEGNKAKLEKLFGFLLEYVGDLATDDPPDLTVIDKLVVHLYHLCQMFPESASDAIKFVLRDAMHEMEEMIETKGRAALPGLDVLIYLKITGLLFPTSDFWHPVVTPALVCLSQLLTKCPILSLQDVVKGLFVCCLFLEYVALSQRFIPELINFLLGILYIATPNKASQGSTLVHPFRALGKNSELLVVSAREDVATWQQSSLSLRWASRLRAPTSTEANHIRLSCLAVGLALLKRCVLMYGSLPSFHAIMGPLQALLTDHLADCSHPQELQELCQSTLTEMESQKQLCRPLTCEKSKPVPLKLFTPRLVKVLEFGRKQGSSKEEQERKRLIHKHKREFKGAVREIRKDNQFLARMQLSEIMERDAERKRKVKQLFNSLATQEGEWKALKRKKFKK

SEQ ID NO: 1364 - protein, 211 aa, Human
MSLSSLCPVFSAAASSLQVHLLKDQLAAEAAARLEAQARVHQLLLQNKDMLQHISLLVKQVQELELKLSGQNAMGSQDSLLEITFRSGALPVLCDPTTPKPEDLHSPPLGAGLADFAHPAGSPLGRRDCLVKLECFRFLPPEDTPPPAQGEALLGGLELIKFRESGIASEYESNTDESEERDSWSQEELPRLLNVLQRQELGDGLDDEIAV

SEQ ID NO: 1365 - protein, 535 aa, Human
MSEGESQTVLSSGSDPKVESSSSAPGLTSVSPPVTSTTSAASPEEEEESEDESEILEESPCGRWQKRREEVNQRNVPGIDSAYLAMDTEEGVEVVWNEVQFSERKNYKLQEEKVRAVFDNLIQLEHLNIVKFHKYWADIKENKARVIFITEYMSSGSLKQFLKKTKKNHKTMNEKAWKRWCTQILSALSYLHSCDPPIIHGNLTCDTIFIQHNGLIKIGSVAPDTINNHVKTCREEQKNLHFFAPEYGEVTNVTTAVDIYSFGMCALEMAVLEIQGNGESSYVPQEAISSAIQLLEDPLQREFIQKCLQSEPARRPTARELLFHPALFEVPSLKLLAAHCIVGHQHMIPENALEEITKNMDTSAVLAEIPAGPGREPVQTLYSQSPALELDKFLEDVRNGIYPLTAFGLPRPQQPQQEEVTSPVVPPSVKTPTPEPAEVETRKVVLMQCNIESVEEGVKHHLTLLLKLEDKLNRHLSCDLMPNENIPELAAELVQLGFISEADQSRLTSLLEETLNKFNFARNSTLNSAAVTVSS

SEQ ID NO: 1366 - protein, 1014 aa, Human
MAESSDKLYRVEYAKSGRASCKKCSESIPKDSLRMAIMVQSPMFDGKVPHWYHFSCFWKVGHSIRHPDVEVDGFSELRWDDQQKVKKTAEAGGVTGKGQDGIGSKAEKTLGDFAAEYAKSNRSTCKGCMEKIEKGQVRLSKKMVDPEKPQLGMIDRWYHPGCFVKNREELGFRPEYSASQLKGFSLLATEDKEALKKQLPGVKSEGKRKGDEVDGVDEVAKKKSKKEKDKDSKLEKALKAQNDLIWNIKDELKKVCSTNDLKELLIFNKQQVPSGESAILDRVADGMVFGALLPCEECSGQLVFKSDAYYCTGDVTAWTKCMVKTQTPNRKEWVTPKEFREISYLKKLKVKKQDRIFPPETSASVAATPPPSTASAPAAVNSSASADKPLSNMKILTLGKLSRNKDEVKAMIEKLGGKLTGTANKASLCISTKKEVEKMNKKMEEVKEANIRVVSEDFLQDVSASTKSLQELFLAHILSPWGAEVKAEPVEVVAPRGKSGAALSKKSKGQVKEEGINKSEKRMKLTLKGGAAVDPDSGLEHSAHVLEKGGKVFSATLGLVDIVKGTNSYYKLQLLEDDKENRYWIFRSWGRVGTVIGSNKLEQMPSKEDAIEHFMKLYEEKTGNAWHSKNFTKYPKKFYPLEIDYGQDEEAVKKLTVNPGTKSKLPKPVQDLIKMIFDVESMKKAMVEYEIDLQKMPLGKLSKRQIQAAYSILSEVQQAVSQGSSDSQILDLSNRFYTLIPHDFGMKKPPLLNNADSVQAKVEMLDNLLDIEVAYSLLRGGSDDSSKDPIDVNYEKLKTDIKVVDRDSEEAEIIRKYVKNTHATTHNAYDLEVIDIFKIEREGECQRYKPFKQLHNRRLLWHGSRTTNFAGILSQGLRIAPPEAPVTGYMFGKGIYFADMVSKSANYCHTSQGDPIGLILLGEVALGNMYELKHASHISKLPKGKHSVKGLGKTTPDPSANISLDGVDVPLGTGISSGVNDTSLLYNEYIVYDIAQVNLKYLLKLKFNFKTSLW

SEQ ID NO: 1367 - protein, 1178 aa, Human
MLKFRTVHGGLRLLGIRRTSTAPAASPNVRRLEYKPIKKVMVANRGEIAIRVFRACTELGIRTVAIYSEQDTGQMHRQKADEAYLIGRGLAPVQAYLHIPDIIKVAKENNVDAVHPGYGFLSERADFAQACQDAGVRFIGPSPEVVRKMGDKVEARAIAIAAGVPVVPGTDAPITSLHEAHEFSNTYGFPIIFKAAYGGGGRGMRVVHSYEELEENYTRAYSEALAAFGNGALFVEKFIEKPRHIEVQILGDQYGNILHLYERDCSIQRRHQKVVEIAPAAHLDPQLRTRLTSDSVKLAKQVGYENAGTVEFLVDRHGKHYFIEVNSRLQVEHTVTEEITDVDLVHAQIHVAEGRSLPDLGLRQENIRINGCAIQCRVTTEDPARSFQPDTGRIEVFRSGEGMGIRLDNASAFQGAVISPHYDSLLVKVIAHGKDHPTAATKMSRALAEFRVRGVKTNIAFLQNVLNNQQFLAGTVDTQFIDENPELFQLRPAQNRAQKLLHYLGHVMVNGPTTPIPVKASPSPTDPVVPAVPIGPPPAGFRDILLREGPEGFARAVRNHPGLLLMDTTFRDAHQSLLATRVRTHDLKKIAPYVAHNFSKLFSMENWGGATFDVAMRFLYECPWRRLQELRELIPNIPFQMLLRGANAVGYTNYPDNVVFKFCEVAKENGMDVFRVFDSLNYLPNMLLGMEAAGSAGGVVEAAISYTGDVADPSRTKYSLQYYMGLAEELVRAGTHILCIKDMAGLLKPTACTMLVSSLRDRFPDLPLHIHTHDTSGAGVAAMLACAQAGADVVDVAADSMSGMTSQPSMGALVACTRGTPLDTEVPMERVFDYSEYWEGARGLYAAFDCTATMKSGNSDVYENEIPGGQYTNLHFQAHSMGLGSKFKEVKKAYVEANQMLGDLIKVTPSSKIVGDLAQFMVQNGLSRAEAEAQAEELSFPRSVVEFLQGYIGVPHGGFPEPFRSKVLKDLPRVEGRPGASLPPLDLQALEKELVDRHGEEVTPEDVLSAAMYPDVFAHFKDFTATFGPLDSLNTRLFLQGPKIAEEFEVELERGKTLHIKALAVSDLNRAGQRQVFFELNGQLRSILVKDTQAMKEMHFHPKALKDVKGQIGAPMPGKVIDIKVVAGAKVAKGQPLCVLSAMKMETVVTSPMEGTVRKVHVTKDMTLEGDDLILEIE

SEQ ID NO: 1368 - protein, 1066 aa, Human
MGFELDRFDGDVDPDLKCALCHKVLEDPLTTPCGHVFCAGCVLPWVVQEGSCPARCRGRLSAKELNHVLPLKRLILKLDIKCAYATRGCGRVVKLQQLPEHLERCDFAPARCRHAGCGQVLLRRDVEAHMRDACDARPVGRCQEGCGLPLTHGEQRAGGHCCARALRAHNGALQARLGALHKALKKEALRAGKREKSLVAQLAAAQLELQMTALRYQKKFTEYSARLDSLSRCVAAPPGGKGEETKSLTLVLHRDSGSLGFNIIGGRPSVDNHDGSSSEGIFVSKIVDSGPAAKEGGLQIHDRIIEVNGRDLSRATHDQAVEAFKTAKEPIVVQVLRRTPRTKMFTPPSESQLVDTGTQTDITFEHIMALTKMSSPSPPVLDPYLLPEEHPSAHEYYDPNDYIGDIHQEMDREELELEEVDLYRMNSQDKLGLTVCYRTDDEDDIGIYISEIDPNSIAAKDGRIREGDRIIQINGIEVQNREEAVALLTSEENKNFSLLIARPELQLDEGWMDDDRNDFLDDLHMDMLEEQHHQAMQFTASVLQQKKHDEDGGTTDTATILSNQHEKDSGVGRTDESTRNDESSEQENNGDDATASSNPLAGQRKLTCSQDTLGSGDLPFSNESFISADCTDADYLGIPVDECERFRELLELKCQVKSATPYGLYYPSGPLDAGKSDPESVDKELELLNEELRSIELECLSIVRAHKMQQLKEQYRESWMLHNSGFRNYNTSIDVRRHELSDITELPEKSDKDSSSAYNTGESCRSTPLTLEISPDNSLRRAAEGISCPSSEGAVGTTEAYGPASKNLLSITEDPEVGTPTYSPSLKELDPNQPLESKERRASDGSRSPTPSQKLGSAYLPSYHHSPYKHAHIPAHAQHYQSYMQLIQQKSAVEYAQSQMSLVSMCKDLSSPTPSEPRMEWKVKIRSDGTRYITKRPVRDRLLRERALKIREERSGMTTDDDAVSEMKMGRYWSKEERKQHLVKAKEQRRRREFMMQSRLDCLKEQQAADDRKEMNILELSHKKMMKKRNKKIFDNWMTIQELLTHGTKSPDGTRVYNSFLSVTTV

SEQ ID NO: 1369 - protein, 130 aa, Human
MAEYGTLLQDLTNNITLEDLEQLKSACKEDIPSEKSEEITTGSAWFSFLESHNKLDKDNLSYIEHIFEISRRPDLLTMVVDYRTRVLKISEEDELDTKLTRIPSAKKYKDIIRQPSEEEIIKLAPPPKKA

SEQ ID NO: 1370 - protein, 1290 aa, Human
MSGPLEGADGGGDPRPGESFCPGGVPSPGPPQHRPCPGPSLADDTDANSNGSSGNESNGHESRGASQRSSHSSSSGNGKDSALLETTESSKSTNSQSPSPPSSSIAYSLLSASSEQDNPSTSGCSSEQSARARTQKELMTALRELKLRLPPERRGKGRSGTLATLQYALACVKQVQANQEYYQQWSLEEGEPCSMDMSTYTLEELEHITSEYTLQNQDTFSVAVSFLTGRIVYISEQAAVLLRCKRDVFRGTRFSELLAPQDVGVFYGSTAPSRLPTWGTGASAGSGLRDFTQEKSVFCRIRGGPDRDPGPRYQPFRLTPYVTKIRVSDGAPAQPCCLLIAERIHSGYEAPRIPPDKRIFTTRHTPSCLFQDVDERAAPLLGYLPQDLLGAPVLLFLHPEDRPLMLAIHKKILQLAGQPFDHSPIRFCARNGEYVTMDTSWAGFVHPWSRKVAFVLGRHKVRTAPLNEDVFTPPAPSPAPSLDTDIQELSEQIHRLLLQPVHSPSPTGLCGVGAVTSPGPLHSPGSSSDSNGGDAEGPGPPAPVTFQQICKDVHLVKHQGQQLFIESRARPQSRPRLPATGTFKAKALPCQSPDPELEAGSAPVQAPLALVPEEAERKEASSCSYQQINCLDSILRYLESCNLPSTTKRKCASSSSYTTSSASDDDRQRTGPVSVGTKKDPPSAALSGEGATPRKEPVVGGTLSPLALANKAESVVSVTSQCSFSSTIVHVGDKKPPESDIIMMEDLPGLAPGPAPSPAPSPTVAPDPAPDAYRPVGLTKAVLSLHTQKEEQAFLSRFRDLGRLRGLDSSSTAPSALGERGCHHGPAPPSRRHHCRSKAKRSRHHQNPRAEAPCYVSHPSPVPPSTPWPTPPATTPFPAVVQPYPLPVFSPRGGPQPLPPAPTSVPPAAFPAPLVTPMVALVLPNYLFPTPSSYPYGALQTPAEGPPTPASHSPSPSLPALAPSPPHRPDSPLFNSRCSSPLQLNLLQLEELPRAEGAAVAGGPGSSAGPPPPSAEAAEPEARLAEVTESSNQDALSGSSDLLELLLQEDSRSGTGSAASGSLGSGLGSGSGSGSHEGGSTSASITRSSQSSHTSKYFGSIDSSEAEAGAARGGAEPGDQVIKYVLQDPIWLLMANADQRVMMTYQVPSRDMTSVLKQDRERLRAMQKQQPRFSEDQRRELGAVHSWVRKGQLPRALDVMACVDCGSSTQDPGHPDDPLFSELDGLGLEPMEEGGGEQGSSGGGSGEGEGCEEAQGGAKASSSQDLAMEEEEEGRSSSSPALPTAGNCTS

SEQ ID NO: 1371 - protein, 1004 aa, Human
MWEKMETKTIVYDLDTSGGLMEQIQALLAPPKTDEAEKRSRKPEKEPRRSGRATNHDSCDSCKEGGDLLCCDHCPAAFHLQCCNPPLSEEMLPPGEWMCHRCTVRRKKREQKKELGHVNGLVDKSGKRTTSPSSDTDLLDRSASKTELKAIAHARILERRASRPGTPTSSASTETPTSEQNDVDEDIIDVDEEPVAAEPDYVQPQLRRPFELLIAAAMERNPTQFQLPNELTCTTALPGSSKRRRKEETTGKNVKKTQHELDHNGLVPLPVKVCFTCNRSCRVAPLIQCDYCPLLFHMDCLEPPLTAMPLGRWMCPNHIEHVVLNQKNMTLSNRCQVFDRFQDTVSQHVVKVDFLNRIHKKHPPNRRVLQSVKRRSLKVPDAIKSQYQFPPPLIAPAAIRDGELICNGIPEESQMHLLNSEHLATQAEQQEWLCSVVALQCSILKHLSAKQMPSHWDSEQTEKADIKPVIVTDSSVTTSLQTADKTPTPSHYPLSCPSGISTQNSLSCSPPHQSPALEDIGCSSCAEKSKKTPCGTANGPVNTEVKANGPHLYSSPTDSTDPRRLPGANTPLPGLSHRQGWPRPLTPPAAGGLQNHTVGIIVKTENATGPSSCPQRSLVPVPSLPPSIPSSCASIENTSTLQRKTVQSQIGPPLTDSRPLGSPPNATRVLTPPQAAGDGILATTANQRFSSPAPSSDGKVSPGTLSIGSALTVPSFPANSTAMVDLTNSLRAFMDVNGEIEINMLDEKLIKFLALQRIHQLFPSRVQPSPGSVGTHQLASGGHHIEVQRKEVQARAVFYPLLGLGGAVNMCYRTLYIGTGADMDVCLTNYGHCNYVSGKHACIFYDENTKHYELLNYSEHGTTVDNVLYSCDFSEKTPPTPPSSIVAKVQSVIRRRRHQKQDEEPSEEAAMMSSQAQGPQRRPCNCKASSSSLIGGSGAGWEGTALLHHGSYIKLGCLQFVFSITEFATKQPKGDASLLQDGVLAEKLSLKPHQGPVLRSNSVP

SEQ ID NO: 1372 - protein, 533 aa, Human
MAFANLRKVLISDSLDPCCRKILQDGGLQVVEKQNLSKEELIAELQDCEGLIVRSATKVTADVINAAEKLQVVGRAGTGVDNVDLEAATRKGILVMNTPNGNSLSAAELTCGMIMCLARQIPQATASMKDGKWERKKFMGTELNGKTLGILGLGRIGREVATRMQSFGMKTIGYDPIISPEVSASFGVQQLPLEEIWPLCDFITVHTPLLPSTTGLLNDNTFAQCKKGVRVVNCARGGIVDEGALLRALQSGQCAGAALDVFTEEPPRDRALVDHENVISCPHLGASTKEAQSRCGEEIAVQFVDMVKGKSLTGVVNAQALTSAFSPHTKPWIGLAEALGTLMRAWAGSPKGTIQVITQGTSLKNAGNCLSPAVIVGLLKEASKQADVNLVNAKLLVKEAGLNVTTSHSPAAPGEQGFGECLLAVALAGAPYQAVGLVQGTTPVLQGLNGAVFRPEVPLRRDLPLLLFRTQTSDPAMLPTMIGLLAEAGVRLLSYQTSLVSDGETWHVMGISSLLPSLEAWKQHVTEAFQFHF

SEQ ID NO: 1373 - protein, 646 aa, Human
MEPAAGFLSPRPFQRAAAAPAPPAGPGPPPSALRGPELEMLAGLPTSDPGRLITDPRSGRTYLKGRLLGKGGFARCYEATDTETGSAYAVKVIPQSRVAKPHQREKILNEIELHRDLQHRHIVRFSHHFEDADNIYIFLELCSRKSLAHIWKARHTLLEPEVRYYLRQILSGLKYLHQRGILHRDLKLGNFFITENMELKVGDFGLAARLEPPEQRKKTICGTPNYVAPEVLLRQGHGPEADVWSLGCVMYTLLCGSPPFETADLKETYRCIKQVHYTLPASLSLPARQLLAAILRASPRDRPSIDQILRHDFFTKGYTPDRLPISSCVTVPDLTPPNPARSLFAKVTKSLFGRKKKSKNHAQERDEVSGLVSGLMRTSVGHQDARPEAPAASGPAPVSLVETAPEDSSPRGTLASSGDGFEEGLTVATVVESALCALRNCIAFMPPAEQNPAPLAQPEPLVWVSKWVDYSNKFGFGYQLSSRRVAVLFNDGTHMALSANRKTVHYNPTSTKHFSFSVGAVPRALQPQLGILRYFASYMEQHLMKGGDLPSVEEVEVPAPPLLLQWVKTDQALLMLFSDGTVQVNFYGDHTKLILSGWEPLLVTFVARNRSACTYLASHLRQLGCSPDLRQRLRYALRLLRDRSPA

SEQ ID NO: 1374 - protein, 1838 aa, Human
MALQLWALTLLGLLGAGASLRPRKLDFFRSEKELNHLAVDEASGVVYLGAVNALYQLDAKLQLEQQVATGPALDNKKCTPPIEASQCHEAEMTDNVNQLLLLDPPRKRLVECGSLFKGICALRALSNISLRLFYEDGSGEKSFVASNDEGVATVGLVSSTGPGGDRVLFVGKGNGPHDNGIIVSTRLLDRTDSREAFEAYTDHATYKAGYLSTNTQQFVAAFEDGPYVFFVFNQQDKHPARNRTLLARMCREDPNYYSYLEMDLQCRDPDIHAAAFGTCLAASVAAPGSGRVLYAVFSRDSRSSGGPGAGLCLFPLDKVHAKMEANRNACYTGTREARDIFYKPFHGDIQCGGHAPGSSKSFPCGSEHLPYPLGSRDGLRGTAVLQRGGLNLTAVTVAAENNHTVAFLGTSDGRILKVYLTPDGTSSEYDSILVEINKRVKRDLVLSGDLGSLYAMTQDKVFRLPVQECLSYPTCTQCRDSQDPYCGWCVVEGRCTRKAECPRAEEASHWLWSRSKSCVAVTSAQPQNMSRRAQGEVQLTVSPLPALSEEDELLCLFGESPPHPARVEGEAVICNSPSSIPVTPPGQDHVAVTIQLLLRRGNIFLTSYQYPFYDCRQAMSLEENLPCISCVSNRWTCQWDLRYHECREASPNPEDGIVRAHMEDSCPQFLGPSPLVIPMNHETDVNFQGKNLDTVKGSSLHVGSDLLKFMEPVTMQESGTFAFRTPKLSHDANETLPLHLYVKSYGKNIDSKLHVTLYNCSFGRSDCSLCRAANPDYRCAWCGGQSRCVYEALCNTTSECPPPVITRIQPETGPLGGGIRITILGSNLGVQAGDIQRISVAGRNCSFQPERYSVSTRIVCVIEAAETPFTGGVEVDVFGKLGRSPPNVQFTFQQPKPLSVEPQQGPQAGGTTLTIHGTHLDTGSQEDVRVTLNGVPCKVTKFGAQLQCVTGPQATRGQMLLEVSYGGSPVPNPGIFFTYRENPVLRAFEPLRSFASGGRSINVTGQGFSLIQRFAMVVIAEPLQSWQPPREAESLQPMTVVGTDYVFHNDTKVVFLSPAVPEEPEAYNLTVLIEMDGHRALLRTEAGAFEYVPDPTFENFTGGVKKQVNKLIHARGTNLNKAMTLQEAEAFVGAERCTMKTLTETDLYCEPPEVQPPPKRRQKRDTTHNLPEFIVKFGSREWVLGRVEYDTRVSDVPLSLILPLVIVPMVVVIAVSVYCYWRKSQQAEREYEKIKSQLEGLEESVRDRCKKEFTDLMIEMEDQTNDVHEAGIPVLDYKTYTDRVFFLPSKDGDKDVMITGKLDIPEPRRPVVEQALYQFSNLLNSKSFLINFIHTLENQREFSARAKVYFASLLTVALHGKLEYYTDIMHTLFLELLEQYVVAKNPKLMLRRSETVVERMLSNWMSICLYQYLKDSAGEPLYKLFKAIKHQVEKGPVDAVQKKAKYTLNDTGLLGDDVEYAPLTVSVIVQDEGVDAIPVKVLNCDTISQVKEKIIDQVYRGQPCSCWPRPDSVVLEWRPGSTAQILSDLDLTSQREGRWKRVNTLMHYNVRDGATLILSKVGVSQQPEDSQQDLPGERHALLEEENRVWHLVRPTDEVDEGKSKRGSVKEKERTKAITEIYLTRLLSVKGTLQQFVDNFFQSVLAPGHAVPPAVKYFFDFLDEQAEKHNIQDEDTIHIWKTNSLPLRFWVNILKNPHFIFDVHVHEVVDASLSVIAQTFMDACTRTEHKLSRDSPSNKLLYAKEISTYKKMVEDYYKGIRQMVQVSDQDMNTHLAEISRAHTDSLNTLVALHQLYQYTQKYYDEIINALEEDPAAQKMQLAFRLQQIAAALENKVTDL

SEQ ID NO: 1375 - protein, 252 aa, Human
MESEMETQSARAEEGFTQVTRKGGRRAKKRQAEQLSAAGEGGDAGRMDTEEARPAKRPVFPPLCGDGLLSGKEETRKIPVPANRYTPLKENWMKIFTPIVEHLGLQIRFNLKSRNVEIRTCKETKDVSALTKAADFVKAFILGFQVEDALALIRLDDLFLESFEITDVKPLKGDHLSRAIGRIAGKGGKTKFTIENVTRTRIVLADVKVHILGSFQNIKMARTAICNLILGNPPSKVYGNIRAVASRSADRF

SEQ ID NO: 1376 - protein, 216 aa, Human
MLRLSERNMKVLLAAALIAGSVFFLLLPGPSAADEKKKGPKVTVKVYFDLRIGDEDVGRVIFGLFGKTVPKTVDNFVALATGEKGFGYKNSKFHRVIKDFMIQGGDFTRGDGTGGKSIYGERFPDENFKLKHYGPGWVSMANAGKDTNGSQFFITTVKTAWLDGKHVVFGKVLEGMEVVRKVESTKTDSRDKPLKDVIIADCGKIEVEKPFAIAKE

SEQ ID NO: 1377 - protein, 689 aa, Human
MEDTGIQRGIWDGDAKAVQQCLTDIFTSVYTTCDIPENAIFGPCVLSHTSLYDSIAFIALKSTDKRTVPYIFRVDTSAANGSSEGLMWLRLVQSARDKEEQNLEAYIKNGQLFYRSLRRIAKDEELLVWYGKELTELLLLCPSRSHNKMNGSSPYTCLECSQRFQFEFPYVAHLRFRCPKRLHSADISPQDEQGGGVGTKDHGGGGGGGKDQQQQQQEAPLGPGPKFCKAGPLHHYPSPSPESSNPSAAAGGSSAKPSTDFHNLARELENSRGGSSCSPAQSLSSGSGSGGGGGHQEAELSPDGIATGGGKGKRKFPEEAAEGGGGAGLVGGRGRFVERPLPASKEDLVCTPQQYRASGSYFGLEENGRLFAPPSPETGEAKRSAFVEVKKAARAASLQEEGTADGAGVASEDQDAGGGGGSSTPAAASPVGAEKLLAPRPGGPLPSRLEGGSPARGSAFTSVPQLGSAGSTSGGGGTGAGAAGGAGGGQGAASDERKSAFSQPARSFSQLSPLVLGQKLGALEPCHPADGVGPTRLYPAAADPLAVKLQGAADLNGGCGSLPSGGGGLPKQSPFLYATAFWPKSSAAAAAAAAAAAAGPLQLQLPSALTLLPPSFTSLCLPAQNWCAKCNASFRMTSDLVYHMRSHHKKEYAMEPLVKRRREEKLKCPICNESFRERHHLSRHMTSHN

SEQ ID NO: 1378 - protein, 546 aa, Human
MANNSPALTGNSQPQHQAAAAAAQQQQQCGGGGATKPAVSGKQGNVLPLWGNEKTMNLNPMILTNILSSPYFKVQLYELKTYHEVVDEIYFKVTHVEPWEKGSRKTAGQTGMCGGVRGVGTGGIVSTAFCLLYKLFTLKLTRKQVMGLITHTDSPYIRALGFMYIRYTQPPTDLWDWFESFLDDEEDLDVKAGGGCVMTIGEMLRSFLTKLEWFSTLFPRIPVPVQKNIDQQIKTRPRKIKKDGKEGAEEIDRHVERRRSRSPRRSLSPRRSPRRSRSRSHHREGHGSSSFDRELEREKERQRLEREAKEREKERRRSRSIDRGLERRRSRSRERHRSRSRSRDRKGDRRDRDREREKENERGRRRDRDYDKERGNEREKERERSRERSKEQRSRGEVEEKKHKEDKDDRRHRDDKRDSKKEKKHSRSRSRERKHRSRSRSRNAGKRSRSRSKEKSSKHKNESKEKSNKRSRSGSQGRTDSVEKSKKREHSPSKEKSRKRSRSKERSHKRDHSDSKDQSDKHDRRRSQSIEQESQEKQHKNKDETV

SEQ ID NO: 1379 - protein, 168 aa, Human
MQAQQYQQQRRKFAAAFLAFIFILAAVDTAEAGKKEKPEKKVKKSDCGEWQWSVCVPTSGDCGLGTREGTRTGAECKQTMKTQRCKIPCNWKKQFGAECKYQFQAWGECDLNTALKTRTGSLKRALHNAECQKTVTISKPCGKLTKPKPQAESKKKKKEGKKQEKMLD

SEQ ID NO: 1380 - protein, 479 aa, Human
MARAAALLPSRSPPTPLLWPLLLLLLLETGAQDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFATFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPRASPRDVGPLVWGAVGGTLLVLLLLAGGSLAFILLRVRRRRKSPGGAGGGASGDGGFYDPKAQVLGNGDPVFWTPVVPGPMEPDGKDEEEEEEEEKAEKGLMLPPPPALEDDMESQLDGSLISRRAVYV

SEQ ID NO: 1381 - protein, 319 aa, Human
MSVGFIGAGQLAFALAKGFTAAGVLAAHKIMASSPDMDLATVSALRKMGVKLTPHNKETVQHSDVLFLAVKPHIIPFILDEIGADIEDRHIVVSCAAGVTISSIEKKLSAFRPAPRVIRCMTNTPVVVREGATVYATGTHAQVEDGRLMEQLLSSVGFCTEVEEDLIDAVTGLSGSGPAYAFTALDALADGGVKMGLPRRLAVRLGAQALLGAAKMLLHSEQHPGQLKDNVSSPGGATIHALHVLESGGFRSLLINAVEASCIRTRELQSMADQEQVSPAAIKKTILDKVKLDSPAGTALSPSGHTKLLPRSLAPAGKD

SEQ ID NO: 1382 - protein, 248 aa, Human
MRLIQNMCTIAEYPAPGNAAASDCCVGAAGRRLVKIAVVGASGVGKTALVVRFLTKRFIGDYERNAGNLYTRQVQIEGETLALQVQDTPGIQVHENSLSCSEQLNRCIRWADAVVIVFSITDYKSYELISQLHQHVQQLHLGTRLPVVVVANKADLLHIKQVDPQLGLQLASMLGCSFYEVSVSENYNDVYSAFHVLCKEVSHKQQPSSTPEKRRTSLIPRPKSPNMQDLKRRFKQALSAKVRTVTSV

SEQ ID NO: 1383 - protein, 311 aa, Human
MAEASPHPGRYFCHCCSVEIVPRLPDYICPRCESGFIEELPEETRSTENGSAPSTAPTDQSRPPLEHVDQHLFTLPQGYGQFAFGIFDDSFEIPTFPPGAQADDGRDPESRRERDHPSRHRYGARQPRARLTTRRATGRHEGVPTLEGIIQQLVNGIITPATIPSLGPWGVLHSNPMDYAWGANGLDAIITQLLNQFENTGPPPADKEKIQALPTVPVTEEHVGSGLECPVCKDDYALGERVRQLPCNHLFHDGCIVPWLEQHDSCPVCRKSLTGQNTATNPPGLTGVSFSSSSSSSSSSSPSNENATSNS

SEQ ID NO: 1384 - protein, 237 aa, Human
MAMFRSLVASAQQRQPPAGPAGGDSGLEAQYTCPICLEVYHRPVAIGSCGHTFCGECLQPCLQVPSPLCPLCRLPFDPKKVDKATHVEKQLSSYKAPCRGCNKKVTLAKMRVHISSCLKVQEQMANCPKFVPVVPTSQPIPSNIPNRSTFACPYCGARNLDQQELVKHCVESHRSDPNRVVCPICSAMPWGDPSYKSANFLQHLLHRHKFSYDTFVDYSIDEEAAFQAALALSLSEN

SEQ ID NO: 1385 - protein, 485 aa, Human
MGEPGFFVTGDRAGGRSWCLRRVGMSAGWLLLEDGCEVTVGRGFGVTYQLVSKICPLMISRNHCVLKQNPEGQWTIMDNKSLNGVWLNRARLEPLRVYSIHQGDYIQLGVPLENKENAEYEYEVTEEDWETIYPCLSPKNDQMIEKNKELRTKRKFSLDELAGPGAEGPSNLKSKINKVSCESGQPVKSQGKGEVASTPSDNLDPKLTALEPSKTTGAPIYPGFPKVTEVHHEQKASNSSASQRSLQMFKVTMSRILRLKIQMQEKHEAVMNVKKQTQKGNSKKVVQMEQELQDLQSQLCAEQAQQQARVEQLEKTFQEEEQHLQGLEIAQGEKDLKQQLAQALQEHWALMEELNRSKKDFEAIIQAKNKELEQTKEEKEKMQAQKEEVLSHMNDVLENELQCIICSEYFIEAVTLNCAHSFCSYCINEWMKRKIECPICRKDIKSKTYSLVLDNCINKMVNNLSSEVKERRIVLIRERKAKRLF

SEQ ID NO: 1386 - protein, 1378 aa, Human
MSLLMFTQLLLCGFLYVRVDGSRLRQEDFPPRIVEHPSDVIVSKGEPTTLNCKAEGRPTPTIEWYKDGERVETDKDDPRSHRMLLPSGSLFFLRIVHGRRSKPDEGSYVCVARNYLGEAVSRNASLEVALLRDDFRQNPTDVVVAAGEPAILECQPPRGHPEPTIYWKKDKVRIDDKEERISIRGGKLMISNTRKSDAGMYTCVGTNMVGERDSDPAELTVFERPTFLRRPINQVVLEEEAVEFRCQVQGDPQPTVRWKKDDADLPRGRYDIKDDYTLRIKKTMSTDEGTYMCIAENRVGKMEASATLTVRAPPQFVVRPRDQIVAQGRTVTFPCETKGNPQPAVFWQKEGSQNLLFPNQPQQPNSRCSVSPTGDLTITNIQRSDAGYYICQALTVAGSILAKAQLEVTDVLTDRPPPIILQGPANQTLAVDGTALLKCKATGDPLPVISWLKEGFTFPGRDPRATIQEQGTLQIKNLRISDTGTYTCVATSSSGETSWSAVLDVTESGATISKNYDLSDLPGPPSKPQVTDVTKNSVTLSWQPGTPGTLPASAYIIEAFSQSVSNSWQTVANHVKTTLYTVRGLRPNTIYLFMVRAINPQGLSDPSPMSDPVRTQDISPPAQGVDHRQVQKELGDVLVRLHNPVVLTPTTVQVTWTVDRQPQFIQGYRVMYRQTSGLQATSSWQNLDAKVPTERSAVLVNLKKGVTYEIKVRPYFNEFQGMDSESKTVRTTEEAPSAPPQSVTVLTVGSYNSTSISVSWDPPPPDHQNGIIQEYKIWCLGNETRFHINKTVDAAIRSVIIGGLFPGIQYRVEVAASTSAGVGVKSEPQPIIIGRRNEVVITENNNSITEQITDVVKQPAFIAGIGGACWVILMGFSIWLYWRRKKRKGLSNYAVTFQRGDGGLMSNGSRPGLLNAGDPSYPWLADSWPATSLPVNNSNSGPNEIGNFGRGDVLPPVPGQGDKTATMLSDGAIYSSIDFTTKTSYNSSSQITQATPYATTQILHSNSIHELAVDLPDPQWKSSIQQKTDLMGFGYSLPDQNKGNNGGKGGKKKKNKNSSKPQKNNGSTWANVPLPPPPVQPLPGTELEHYAVEQQENGYDSDSWCPPLPVQTYLHQGLEDELEEDDDRVPTPPVRGVASSPAISFGQQSTATLTPSPREEMQPMLQAHLDELTRAYQFDIAKQTWHIQSNNQPPQPPVPPLGYVSGALISDLETDVADDDADDEEEALEIPRPLRALDQTPGSSMDNLDSSVTGKAFTSSQRPRPTSPFSTDSNTSAALSQSQRPRPTKKHKGGRMDQQPALPHRREGMTDEEALVPYSKPSFPSPGGHSSSGTASSKGSTGPRKTEVLRAGHQRNASDLLDIGYMGSNSQGQFTGEL

SEQ ID NO: 1387 - protein, 1386 aa, Human
MLRYLLKTLLQMNLFADSLAGDISNSSELLLGFNSSLAALNHTLLPPGDPSLNGSRVGPEDAMPRIVEQPPDLLVSRGEPATLPCRAEGRPRPNIEWYKNGARVATVREDPRAHRLLLPSGALFFPRIVHGRRARPDEGVYTCVARNYLGAAASRNASLEVAVLRDDFRQSPGNVVVAVGEPAVLECVPPRGHPEPSVSWRKDGARLKEEEGRITIRGGKLMMSHTLKSDAGMYVCVASNMAGERESAAAEVMVLERPSFLRRPVNQVVLADAPVTFLCEVKGDPPPRLRWRKEDGELPTGRYEIRSDHSLWIGHVSAEDEGTYTCVAENSVGRAEASGSLSVHVPPQLVTQPQDQMAAPGESVAFQCETKGNPPPAIFWQKEGSQVLLFPSQSLQPTGRFSVSPRGQLNITAVQRGDAGYYVCQAVSVAGSILAKALLEIKGASLDGLPPVILQGPANQTLVLGSSVWLPCRVTGNPQPSVRWKKDGQWLQGDDLQFKTMANGTLYIANVQEMDMGFYSCVAKSSTGEATWSGWLKMREDWGVSPDPPTEPSSPPGAPSQPVVTEITKNSITLTWKPNPQTGAAVTSYVIEAFSPAAGNTWRTVADGVQLETHTVSGLQPNTIYLFLVRAVGAWGLSEPSPVSEPVRTQDSSPSRPVEDPWRGQQGLAEVAVRLQEPIVLGPRTLQVSWTVDGPVQLVQGFRVSWRVAGPEGGSWTMLDLQSPSQQSTVLRGLPPGTQIQIKVQAQGQEGLGAESLSVTRSIPEEAPSGPPQGVAVALGGDGNSSITVSWEPPLPSQQNGVITEYQIWCLGNESRFHLNRSAAGWARSAMLRGLVPGLLYRTLVAAATSAGVGVPSAPVLVQLPSPPDLEPGLEVGAGLAVRLARVLREPAFLAGSGAACGALLLGLCAALYWRRKQRKELSHYTASFAYTPAVSFPHSEGLSGASSRPPMGLGPAPYSWLADSWPHPSRSPSAQEPRGSCCPSNPDPDDRYYNEAGISLYLAQTARGTAAPGEGPVYSTIDPAGEELQTFHGGFPQHPSGDLGPWSQYAPPEWSQGDSGAKGGKVKLLGKPVQMPSLNWPEALPPPPPSCELSCLEGPEEELEGSSEPEEWCPPMPERSHLTEPSSSGGCLVTPSRRETPSPTPSYGQQSTATLTPSPPDPPQPPTDMPHLHQMPRRVPLGPSSPLSVSQPMLGIREARPAGLGAGPAASPHLSPSPAPSTASSAPGRTWQGNGEMTPPLQGPRARFRKKPKALPYRRENSPGDLPPPPLPPPEEEASWALELRAAGSMSSLERERSGERKAVQAVPLAAQRVLHPDEEAWLPYSRPSFLSRGQGTSTCSTAGSNSSRGSSSSRGSRGPGRSRSRSQSRSQSQRPGQKRREEPR

SEQ ID NO: 1388 - protein, 217 aa, Human
MSSKVSRDTLYEAVREVLHGNQRKRRKFLETVELQISLKNYDPQKDKRFSGTVRLKSTPRPKFSVCVLGDQQHCDEAKAVDIPHMDIEALKKLNKNKKLVKKLAKKYDAFLASESLIKQIPRILGPGLNKAGKFPSLLTHNENMVAKVDEVKSTIKFQMKKVLCLAVAVGHVKMTDDELVYNIHLAVNFLVSLLKKNWQNVRALYIKSTMGKPQRLY

SEQ ID NO: 1389 - protein, 157 aa, Human [sequence omitted]

SEQ ID NO: 1390 - protein, 116 aa, Human
MRGVAEVKEPCSLPMLSVDMENKENGSVGVKNSMENGRPPDPADWAVMDVVNYFRTVGFEEQASAFQEQEIDGKSLLLMTRNDVLTGLQLKLGPALKIYEYHVKPLQTKHLKNNSS

SEQ ID NO: 1391 - protein, 688 aa, Human
MGSENSALKSYTLREPPFTLPSGLAVYPAVLQDGKFASVFVYKRENEDKVNKAAKHLKTLRHPCLLRFLSCTVEADGIHLVTERVQPLEVALETLSSAEVCAGIYDILLALIFLHDRGHLTHNNVCLSSVFVSEDGHWKLGGMETVCKVSQATPEFLRSIQSIRDPASIPPEEMSPEFTTLPECHGHARDAFSFGTLVESLLTILNEQVSADVLSSFQQTLHSTLLNPIPKCRPALCTLLSHDFFRNDFLEVVNFLKSLTLKSEEEKTEFFKFLLDRVSCLSEELIASRLVPLLLNQLVFAEPVAVKSFLPYLLGPKKDHAQGETPCLLSPALFQSRVIPVLLQLFEVHEEHVRMVLLSHIEAYVEHFTQEQLKKVILPQVLLGLRDTSDSIVAITLHSLAVLVSLLGPEVVVGGERTKIFKRTAPSFTKNTDLSLEGDPFSQPIKFPINGLSDVKNTSEDSENFPSSSKKSEEWPDWSEPEEPENQTVNIQIWPREPCDDVKSQCTTLDVEESSWDDCEPSSLDTKVNPGGGITATKPVTSGEQKPIPALLSLTEESMPWKSSLPQKISLVQRGDDADQIEPPKVSSQERPLKVPSELGLGEEFTIQVKKKPVKDPEMDWFADMIPEIKPSAAFLILPELRTEMVPKKDDVSPVMQFSSKFAAAEITEGEAEGWEEEGELNWEDNNW

SEQ ID NO: 1392 - protein, 310 aa, Human
MRRAALWLWLCALALSLQPALPQIVATNLPPEDQDGSGDDSDNFSGSGAGALQDITLSQQTPSTWKDTQLLTAIPTSPEPTGLEATAASTSTLPAGEGPKEGEAVVLPEVEPGLTAREQEATPRPRETTQLPTTHQASTTTATTAQEPATSHPHRDMQPGHHETSTPAGPSQADLHTPHTEDGGPSATERAAEDGASSQLPAAEGSGEQDFTFETSGENTAVVAVEPDRRNQSPVDQGATGASQGLLDRKEVLGGVIAGGLVGLIFAVCLVGFMLYRMKKKDEGSYSLEEPKQANGGAYQKPTKQEEFYA

SEQ ID NO: 1393 - protein, 493 aa, Human
MRRRRAAVAAGFCASFLLGSVLNVLFAPGSEPPRPGQSPEPSPAPGPGRRGGRGELARQIRARYEEVQRYSRGGPGPGAGRPERRRLMDLAPGGPGLPRPRPPWARPLSDGAPGWPPAPGPGSPGPGPRLGCAALRNVSGAQYMGSGYTKAVYRVRLPGGAAVALKAVDFSGHDLGSCVREFGVRRGCYRLAAHKLLKEMVLLERLRHPNVLQLYGYCYQDSEDIPDTLTTITELGAPVEMIQLLQTSWEDRFRICLSLGRLLHHLAHSPLGSVTLLDFRPRQFVLVDGELKVTDLDDARVEETPCAGSTDCILEFPARNFTLPCSAQGWCEGMNEKRNLYNAYRFFFTYLLPHSAPPSLRPLLDSIVNATGELAWGVDETLAQLEKVLHLYRSGQYLQNSTASSSTEYQCIPDSTIPQEDYRCWPSYHHGSCLLSVFNLAEAVDVCESHAQCRAFVVTNQTTWTGRQLVFFKTGWSQVVPDPNKTTYVKASG

SEQ ID NO: 1394 - protein, 313 aa, Human
MDNKKRLAYAIIQFLHDQLRHGGLSSDAQESLEVAIQCLETAFGVTVEDSDLALPQTLPEIFEAAATGKEMPQDLRSPARTPPSEEDSAEAERLKTEGNEQMKVENFEAAVHFYGKAIELNPANAVYFCNRAAAYSKLGNYAGAVQDCERAICIDPAYSKAYGRMGLALSSLNKHVEAVAYYKKALELDPDNETYKSNLKIAELKLREAPSPTGGVGSFDIAGLLNNPGFMSMASNLMNNPQIQQLMSGMISGGNNPLGTPGTSPSQNDLASLIQAGQQFAQQMQQQNPELIEQLRSQIRSRTPSASNDDQQE

SEQ ID NO: 1395 - protein, 919 aa, Human
MEAPEYLDLDEIDFSDDISYSVTSLKTIPELCRRCDTQNEDRSVSSSSWNCGISTLITNTQKPTGIADVYSKFRPVKRVSPLKHQPETLENNESDDQKNQKVVEYQKGGESDLGPQPQELGPGDGVGGPPGKSSEPSTSLGELEHYDLDMDEILDVPYIKSSQQLASFTKVTSEKRILGLCTTINGLSGKACSTGSSESSSSNMAPFCVLSPVKSPHLRKASAVIHDQHKLSTEETEISPPLVKCGSAYEPENQSKDFLNKTFSDPHGRKVEKTTPDCQLRAFHLQSSAAESKPEEQVSGLNRTSSQGPEERSEYLKKVKSILNIVKEGQISLLPHLAADNLDKIHDENGNNLLHIAASQGHAECLQHLTSLMGEDCLNERNTEKLTPAGLAIKNGQLECVRWMVSETEAIAELSCSKDFPSLIHYAGCYGQEKILLWLLQFMQEQGISLDEVDQDGNSAVHVASQHGYLGCIQTLVEYGANVTMQNHAGEKPSQSAERQGHTLCSRYLVVVETCMSLASQVVKLTKQLKEQTVERVTLQNQLQQFLEAQKSEGKSLPSSPSSPSSPASRKSQWKSPDADDDSVAKSKPGVQEGIQVLGSLSASSRARPKAKDEDSDKILRQLLGKEISENVCTQEKLSLEFQDAQASSRNSKKIPLEKRELKLARLRQLMQRSLSESDTDSNNSEDPKTTPVRKADRPRPQPIVESVESMDSAESLHLMIKKHTLASGGRRFPFSIKASKSLDGHSPSPTSESSEPDLESQYPGSGSIPPNQPSGDPQQPSPDSTAAQKVATSPKSALKSPSSKRRTSQNLKLRVTFEEPVVQMEQPSLELNGEKDKDKGRTLQRTSTSNESGDQLKRPFGAFRSIMETLSGNQNNNNNYQAANQLKTSTLPLTSLGRKTDAKGNPASSASKGKNKAA

SEQ ID NO: 1396 - protein, 227 aa, Human
MADLLGSILSSMEKPPSLGDQETRRKAREQAARLKKLQEQEKQQKVEFRKRMEKEVSDFIQDSGQIKKKFQPMNKIERSILHDVVEVAGLTSFSFGEDDDCRYVMIFKKEFAPSDEELDSYRRGEEWDPQKAEEKRKLKELAQRQEEEAAQQGPVVVSPASDYKDKYSHLIGKGAAKDAAHMLQANKTYGCVPVANKRDTRSIEEAMNEIRAKKRLRQSGEELPPTS

SEQ ID NO: 1397 - protein, 1085 aa, Human
MSTPSRFKKDKEIIAEYESQVKEIRAQLVEQQKCLEQQTEMRVQLLQDLQDFFRKKAEIETEYSRNLEKLAERFMAKTRSTKDHQQYKKDQNLLSPVNCWYLLLNQVRRESKDHATLSDIYLNNVIMRFMQISEDSTRMFKKSKEIAFQLHEDLMKVLNELYTVMKTYHMYHAESISAESKLKEAEKQEEKQIGRSGDPVFHIRLEERHQRRSSVKKIEKMKEKRQAKYSENKLKSIKARNEYLLTLEATNASVFKYYIHDLSDLIDCCDLGYHASLNRALRTYLSAEYNLETSRHEGLDIIENAVDNLEPRSDKQRFMEMYPAAFCPPMKFEFQSHMGDEVCQVSAQQPVQAELMLRYQQLQSRLATLKIENEEVKKTTEATLQTIQDMVTIEDYDVSECFQHSRSTESVKSTVSETYLSKPSIAKRRANQQETEQFYFMKLREYLEGSNLITKLQAKHDLLQRTLGEGHRAEYMTTRPPNVPPKPQKHRKSRPRSQYNTKLFNGDLETFVKDSGQVIPLIVESCIRFINLYGLQHQGIFRVSGSQVEVNDIKNSFERGENPLADDQSNHDINSVAGVLKLYFRGLENPLFPKERFNDLISCIRIDNLYERALHIRKLLLTLPRSVLIVMRYLFAFLNHLSQYSDENMMDPYNLAICFGPTLMPVPEIQDQVSCQAHVNEIIKTIIIHHETIFPDAKELDGPVYEKCMAGDDYCDSPYSEHGTLEEVDQDAGTEPHTSEDECEPIEAIAKFDYVGRSARELSFKKGASLLLYHRASEDWWEGRHNGIDGLVPHQYIVVQDMDDTFSDTLSQKADSEASSGPVTEDKSSSKDMNSPTDRHPDGYLARQRKRGEPPPPVRRPGRTSDGHCPLHPPHALSNSSVDLGSPSLASHPRGLLQNRGLNNDSPERRRRPGHGSLTNISRHDSLKKIDSPPIRRSTSSGQYTGFNDHKPLDPETIAQDIEETMNTALNELRELERQSTAKHAPDVVLDTLEQVKNSPTPATSTESLSPLHNVALRSSEPQIRRSTSSSSDTMSTFKPMVAPRMGVQLKPPALRPKPAVLPKTNPTIGPAPPPQGPTDKSCTM

SEQ ID NO: 1398 - protein, 1259 aa, Human
MDRPLSSSAEAEEELEWQVASRRRKAWAKCRSSWQASETEDLSTEATTQDEEEDEEEDLPGAQLPAAGGRGNVPNEKIAIWLKDCRTPLGASLDEQSSSTLKGVLVRNGGSFEDDLSLGAEANHLHESDAQIENCNNILAKERRLQFHQKGRSMNSTGSGKSSGTVSSVSELLELYEEDPEEILYNLGFGRDEPDIASKIPSRFFNSSSFAKGIDIKVFLSAQMQRMEVENPNYALTSRFRQIEVLTTVANAFSSLYSQVSGTPLQRIGSMSSVTSNKETDPPPPLTRSNTANRLMKTLSKLNLCVDKTEKGESSSPSPSAEKGKILNVSVIEESGNKNDQKSQKIMKKKESSSMLATVKEEVSGSSAAVTENADSDRISDEANSNFNQGTENEQSKETQSHESKLGEESGIVESKLDSDFNISSHSELENSSELKSVHISTPEKEPCAPLTIPSIRNIMTQQKDSFEMEEVQSTEGEAPHVPATYQLGLTKSKRDHLLRTASQHSDSSGFAEDSTDCLSLNHLQVQESLQAMGSSADSCDSETTVTSLGEDLATPTAQDQPYFNESEEESLVPLQKGLEKAAAVADKRKSGSQDFPQCNTIENTGTKQSTCSPGDHIIEITEVEEDLFPAETVELLREASAESDVGKSSESEFTQYTTHHILKSLASIEAKCSDMSSENTTGPPSSMDRVNTALQRAQMKVCSLSNQRMGRSLLKSKDLLKQRYLFAKAGYPLRRSQSLPTTLLSPVRVVSSVNVRLSPGKETRCSPPSFTYKYTPEEEQELEKRVMEHDGQSLVKSTIFISPSSVKKEEAPQSEAPRVEECHHGRTPTCSRLAPPPMSQSTCSLHSIHSEWQERPLCEHTRTLSTHSVPNISGATCSAFASPFGCPYSHRHATYPYRVCSVNPPSAIEMQLRRVLHDIRNSLQNLSQYPMMRGPDPAAAPYSTQKSSVLPLYENTFQELQVMRRSLNLFRTQMMDLELAMLRQQTMVYHHMTEEERFEVDQLQGLRNSVRMELQDLELQLEERLLGLEEQLRAVRMPSPFRSSALMGMCGSRSADNLSCPSPLNVMEPVTELMQEQSYLKSELGLGLGEMGFEIPPGESSESVFSQATSESSSVCSGPSHANRRTGVPSTASVGKSKTPLVARKKVFRASVALTPTAPSRTGSVQTPPDLESSEEVDAAEGAPEVVGPKSEVEEGHGKLPSMPAAEEMHKNVEQDELQQVIREIKESIVGEIRREIVSGLLAAVSSSKASNSKQDYH

SEQ ID NO: 1399 - protein, 359 aa, Human
MGLLVFVRNLLLALCLFLVLGFLYYSAWKLHLLQWEEDSKYDRLGFLLNLDSKLPAELATKYANFSEGACKPGYASALMTAIFPRFSKPAPMFLDDSFRKWARIREFVPPFGIKGQDNLIKAILSVTKEYRLTPALDSLRCRRCIIVGNGGVLANKSLGSRIDDYDIVVRLNSAPVKGFEKDVGSKTTLRITYPEGAMQRPEQYERDSLFVLAGFKWQDFKWLKYIVYKERVSASDGFWKSVATRVPKEPPEIRILNPYFIQEAAFTLIGLPFNNGLMGRGNIPTLGSVAVTMALHGCDEVAVAGFGYDMSTPNAPLHYYETVRMAAIKESWTHNIQREKEFLRKLVKARVITDLSSGI

SEQ ID NO: 1400 - protein, 8749 aa, Human
MATSRGASRCPRDIANVMQRLQDEQEIVQKRTFTKWINSHLAKRKPPMVVDDLFEDMKDGVKLLALLEVLSGQKLPCEQGRRMKRIHAVANIGTALKFLEGRKSMHRGSPIKLVNINSTDIADGRPSIVLGLMWTIILYFQIEELTSNLPQLQSLSSSASSVDSIVSSETPSPPSKRKVTTKIQGNAKKALLKWVQYTAGKQTGIEVKDFGKSWRSGVAFHSVIHAIRPELVDLETVKGRSNRENLEDAFTIAETELGIPRLLDPEDVDVDKPDEKSIMTYVAQFLKHYPDIHNASTDGQEDDEILPGFPSFANSVQNFKREDRVIFKEMKVWIEQFERDLTRAQMVESNLQDKYQSFKHFRVQYEMKRKQIEHLIQPLHRDGKLSLDQALVKQSWDRVTSRLFDWHIQLDKSLPAPLGTIGAWLYRAEVALREEITVQQVHEETANTIQRKLEQHKDLLQNTDAHKRAFHEIYRTRSVNGIPVPPDQLEDMAERFHFVSSTSELHLMKMEFLELKYRLLSLLVLAESKLKSWIIKYGRRESVEQLLQNYVSFIENSKFFEQYEVTYQILKQTAEMYVKADGSVEEAENVMKFMNETTAQWRNLSVEVRSVRSMLEEVISNWDRYGNTVASLQAWLEDAEKMLNQSENAKKDFFRNLPHWIQQHTAMNDAGNFLIETCDEMVSRDLKQQLLLLNGRWRELFMEVKQYAQADEMDRMKKEYTDCVVTLSAFATEAHKKLSEPLEVSFMNVKLLIQDLEDIEQRVPVMDAQYKIITKTAHLITKESPQEEGKEMFATMSKLKEQLTKVKECYSPLLYESQQLLIPLEELEKQMTSFYDSLGKINEIITVLEREAQSSALFKQKHQELLACQENCKKTLTLIEKGSQSVQKFVTLSNVLKHFDQTRLQRQIADIHVAFQSMVKKTGDWKKHVETNSRLMKKFEESRAELEKVLRIAQEGLEEKGDPEELLRRHTEFFSQLDQRVLNAFLKACDELTDILPEQEQQGLQEAVRKLHKQWKDLQGEAPYHLLHLKIDVEKNRFLASVEECRTELDRETKLMPQEGSEKIIKEHRVFFSDKGPHHLCEKRLQLIEELCVKLPVRDPVRDTPGTCHVTLKELRAAIDSTYRKLMEDPDKWKDYTSRFSEFSSWISTNETQLKGIKGEAIDTANHGEVKRAVEEIRNGVTKRGETLSWLKSRLKVLTEVSSENEAQKQGDELAKLSSSFKALVTLLSEVEKMLSNFGDCVQYKEIVKNSLEELISGSKEVQEQAEKILDTENLFEAQQLLLHHQQKTKRISAKKRDVQQQIAQAQQGEGGLPDRGHEELRKLESTLDGLERSRERQERRIQVTLRKWERFETNKETVVRYLFQTGSSHERFLSFSSLESLSSELEQTKEFSKRTESIAVQAENLVKEASEIPLGPQNKQLLQQQAKSIKEQVKKLEDTLEEDIKTMEMVKTKWDHFGSNFETLSVWITEKEKELNALETSSSAMDMQISQIKVTIQEIESKLSSIVGLEEEAQSFAQFVTTGESARIKAKLTQIRRYGEELREHAQCLEGTILGHLSQQQKFEENLRKIQQSVSEFEDKLAVPIKICSSATETYKVLQEHMDLCQALESLSSAITAFSASARKVVNRDSCVQEAAALQQQYEDILRRAKERQTALENLLAHWQRLEKELSSFLTWLERGEAKASSPEMDISADRVKVEGELQLIQALQNEVVSQASFYSKLLQLKESLFSVASKDDVKMMKLHLEQLDERWRDLPQIINKRINFLQSVVAEHQQFDELLLSFSVWIKLFLSELQTTSEISIMDHQVALTRHKDHAAEVESKKGELQSLQGHLAKLGSLGRAEDLHLLQGKAEDCFQLFEEASQVVERRQLALSHLAEFLQSHASLSGILRQLRQTVEATNSMNKNESDLIEKDLNDALQNAKALESAAVSLDGILSKAQYHLKIGSSEQRTSCRATADQLCGEVERIQNLLGTKQSEADALAVLKKAFQDQKEELLKSIEDIEERTDKERLKEPTRQALQQRLRVFNQLEDELNSHEHELCWLKDKAKQIAQKDVAFAPEVDREINRLEVTWDDTKRLIHENQGQCCGLIDLMREYQNLKSAVSKVLENASSVIVTRTTIKDQEDLKWAFSKHETAKNKMNYKQKDLDNFTSKGKHLLSELKKIHSSDFSLVKTDMESTVDKWLDVSEKLEENMDRLRVSLSIWDDVLSTRDEIEGWSNNCVPQMAENISNLDNHLRAEELLKEFESEVKNKALRLEELHSKVNDLKELTKNLETPPDLQFIEADLMQKLEHAKEITEVAKGTLKDFTAQSTQVEKFINDITTWFTKVEESLMNCAQNETCEALKKVKDIQKELQSQQSNISSTQENLNSLCRKYHSAELESLGRAMTGLIKKHEAVSQLCSKTQASLQESLEKHFSESMQEFQEWFLGAKAAAKESSDRTGDSKVLEAKLHDLQNILDSVSDGQSKLDAVTQEGQTLYAHLSKQIVSSIQEQITKANEEFQAFLKQCLKDKQALQDCASELGSFEDQHRKLNLWIHEMEERFNTENLGESKQHIPEKKNEVHKVEMFLGELLAARESLDKLSQRGQLLSEEGHGAGQEGRLCSQLLTSHQNLLRMTKEKLRSCQVALQEHEALEEALQSMWFWVKAIQDRLACAESTLGSKDTLEKRLSQIQDILLMKGEGEVKLNMAIGKGEQALRSSNKEGQRVIQTQLETLKEVWADIMSSSVHAQSTLESVISQWNDYVERKNQLEQWMESVDQKIEHPLQPQPGLKEKFVLLDHLQSILSEAEDHTRALHRLIAKSRELYEKTEDESFKDTAQEELKTQFNDIMTVAKEKMRKVEEIVKDHLMYLDAVHEFTDWLHSAKEELHRWSDMSGDSSATQKKLSKIKELIDSREIGASRLSRVESLAPEVKQNTTASGCELMHTEMQALRADWKQWEDSVFQTQSCLENLVSQMALSEQEFSGQVAQLEQALEQFSALLKTWAQQLTLLEGKNTDEEIVECWHKGQEILDALQKAEPRTEDLKSQLNELCRFSRDLSTYSGKVSGLIKEYNCLCLQASKGCQNKEQILQQRFRKAFRDFQQWLVNAKITTAKCFDIPQNISEVSTSLQKIQEFLSESENGQHKLNMMLSKGELLSTLLTKEKAKGIQAKVTAAKEDWKNFHSNLHQKESALENLKIQMKDFEVSAEPIQDWLSKTEKMVHESSNRLYDLPAKRREQQKLQSVLEEIHCYEPQLNRLKEKAQQLWEGQAASKSFRHRVSQLSSQYLALSNLTKEKVSRLDRIVAEHNQFSLGIKELQDWMTDAIHMLDSYCHPTSDKSVLDSRTLKLEALLSVKQEKEIQMKMIVTRGESVLQNTSPEGIPTIQQQLQSVKDMWASLLSAGIRCKSQLEGALSKWTSYQDGVRQFSGWMDSMEANLNESERQHAELRDKTTMLGKAKLLNEEVLSYSSLLETIEVKGAGMTEHYVTQLELQDLQERYRAIQERAKEAVTKSEKLVRLHQEYQRDLKAFEVWLGQEQEKLDQYSVLEGDAHTHETTLRDLQELQVHCAEGQALLNSVLHTREDVIPSGIPQAEDRALESLRQDWQAYQHRLSETRTQFNNVVNKLRLMEQKFQQVDEWLKTAEEKKWHEEVTAYRDEVEEVGARAQEILDESHVNSRMGCQATQLTSRYQALLLQVLEQIKFLEEEIQSLEESESSLSSYSDWYGSTHKNFKNVATKIDKVDTVMMGKKLKTLEVLLKDMEKGHSLLKSAREKGERAVKYLEEGEAERLRKEIHDHMEQLKELTSTVRKEHMTLEKGLHLAKEFSDKCKALTQWIAEYQEILHVPEEPKMELYEKKAQLSKYKSLQQTVLSHEPSVKSVREKGEALLELVQDVTLKDKIDQLQSDYQDLCSIGKAMMEEIAGFEDRLNNLQMKGDTLIGQCADHLQAKLKQNVHAHLQGTKDSYSAICSTAQRMYQSLEHELQKHVSRQDTLQQCQAWLSAVQPDLEPSPQPPLSRAEAIKQVKHFRALQEQARTYLDLLCSMCDLSNASVKTTAKDIQQTEQTIEQKLVQAQNLTQGWEEIKHLKSELWIYLQDADQQLQNMKRRHSELELNIAQNMVSQVKDFVKKLQSKQASVNTIIEKVNKLTKKEESPEHKEINHLNDQWLDLCRQSNNLCLQREEDLQRTRDYHDCMNVVEVFLEKFTTEWDNLARSDAESTAVHLEALKKLALALQERKYAIEDLKDQKQKMIEHLNLDDKELVKEQTSHLEQRWFQLEDLIKRKIQVSVTNLEELNVVQSRFQELMEWAEEQQPNIAEALKQSPPPDMAQNLLMDHLAICSELEAKQMLLKSLIKDADRVMADLGLNERQVIQKALSDAQSHVNCLSDLVGQRRKYLNKALSEKTQFLMAVFQATSQIQQHERKIMFREHICLLPDDVSKQVKTCKSAQASLKTYQNEVTGLWAQGRELMKEVTEQEKSEVLGKLQELQSVYDSVLQKCSHRLQELEKNLVSRKHFKEDFDKACHWLKQADIVTFPEINLMNESSELHTQLAKYQNILEQSPEYENLLLTLQRTGQTILPSLNEVDHSYLSEKLNALPRQFNVIVALAKDKFYKVQEAILARKEYASLIELTTQSLSELEAQFLRMSKVPTDLAVEEALSLQDGCRAILDEVAGLGEAVDELNQKKEGFRSTGQPWQPDKMLHLVTLYHRLKRQTEQRVSLLEDTTSAYQEHEKMCQQLERQLKSVKEEQSKVNEETLPAEEKLKMYHSLAGSLQDSGIVLKRVTIHLEDLAPHLDPLAYEKARHQIQSWQGELKLLTSAIGETVTECESRMVQSIDFQTEMSRSLDWLRRVKAELSGPVYLDLNLQDIQEEIRKIQIHQEEVQSSLRIMNALSHKEKEKFTKAKELISADLEHSLAELSELDGDIQEALRTRQATLTEIYSQCQRYYQVFQAANDWLEDAQELLQLAGNGLDVESAEENLKSHMEFFSTEDQFHSNLEELHSLVATLDPLIKPTGKEDLEQKVASLELRSQRMSRDSGAQVDLLQRCTAQWHDYQKAREEVIELMNDTEKKLSEFSLLKTSSSHEAEEKLSEHKALVSVVNSFHEKIVALEEKASQLEKTGNDASKATLSRSMTTVWQRWTRLRAVAQDQEKILEDAVDEWTGFNNKVKKATEMIDQLQDKLPGSSAEKASKAELLTLLEYHDTFVLELEQQQSALGMLRQQTLSMLQDGAAPTPGEEPPLMQEITAMQDRCLNMQEKVKTNGKLVKQELKDREMVETQINSVKCWVQETKEYLGNPTIEIDAQLEELQILLTEATNHRQNIEKMAEEQKEKYLGLYTILPSELSLQLAEVALDLKIRDQIQDKIKEVEQSKATSQELSRQIQKLAKDLTTILTKLKAKTDNVVQAKTDQKVLGEELDGCNSKLMELDAAVQKFLEQNGQLGKPLAKKIGKLTELHQQTIRQAENRLSKLNQAASHLEEYNEMLELILKWIEKAKVLAHGTIAWNSASQLREQYILHQTLLEESKEIDSELEAMTEKLQYLTSVYCTEKMSQQVAELGRETEELRQMIKIRLQNLQDAAKDMKKFEAELKKLQAALEQAQATLTSPEVGRLSLKEQLSHRQHLLSEMESLKPKVQAVQLCQSALRIPEDVVASLPLCHAALRLQEEASRLQHTAIQQCNIMQAAVVQYEQYEQEMKHLQQLIEGAHREIEDKPVATSNIQELQAQISRHEELAQKIKGYQEQIASLNSKCKMLTMKAKHATMLLTVTEVEGLAEGTEDLDGELLPTPSAHPSVVMMTAGRCHTLLSPVTEESGEEGTNSEISSPPACRSPSPVANTDASVNQDIAYYQALSAERLQTDAAKIHPSTSASQEFYEPGLEPSATAKLGDLQRSWETLKNVISEKQRTLYEALERQQKYQDSLQSISTKMEAIELKLSESPEPGRSPESQMAEHQALMDEILMLQDEINELQSSLAEELVSESCEADPAEQLALQSTLTVLAERMSTIRMKASGKRQLLEEKLNDQLEEQRQEQALQRYRCEADELDSWLLSTKATLDTALSPPKEPMDMEAQLMDCQNMLVEIEQKVVALSELSVHNENLLLEGKAHTKDEAEQLAGKLRRLKGSLLELQRALHDKQLNMQGTAQEKEESDVDLTATQSPGVQEWLAQARTTWTQQRQSSLQQQKELEQELAEQKSLLRSVASRGEEILIQHSAAETSGDAGEKPDVLSQELGMEGEKSSAEDQMRMKWESLHQEFSTKQKLLQNVLEQEQEQVLYSRPNRLLSGVPLYKGDVPTQDKSAVTSLLDGLNQAFEEVSSQSGGAKRQSIHLEQKLYDGVSATSTWLDDVEERLFVATALLPEETETCLFNQEILAKDIKEMSEEMDKNKNLFSQAFPENGDNRDVIEDTLGCLLGRLSLLDSVVNQRCHQMKERLQQILNFQNDLKVLFTSLADNKYIILQKLANVFEQPVAEQIEAIQQAEDGLKEFDAGIIELKRRGDKLQVEQPSMQELSKLQDMYDELMMIIGSRRSGLNQNLTLKSQYERALQDLADLLETGQEKMAGDQKIIVSSKEEIQQLLDKHKEYFQGLESHMILTETLFRKIISFAVQKETQFHTELMAQASAVLKRAHKRGVELEYILETWSHLDEDQQELSRQLEVVESSIPSVGLVEENEDRLIDRITLYQHLKSSLNEYQPKLYQVLDDGKRLLISISCSDLESQLNQLGECWLSNTNKMSKELHRLETILKHWTRYQSESADLIHWLQSAKDRLEFWTQQSVTVPQELEMVRDHLNAFLEFSKEVDAQSSLKSSVLSTGNQLLRLKKVDTATLRSELSRIDSQWTDLLTNIPAVQEKLHQLQMDKLPSRHAISEVMSWISLMENVIQKDEDNIKNSIGYKAIHEYLQKYKGFKIDINCKQLTVDFVNQSVLQISSQDVESKRSDKTDFAEQLGAMNKSWQILQGLVTEKIQLLEGLLESWSEYENNVQCLKTWFETQEKRLKQQHRIGDQASVQNALKDCQDLEDLIKAKEKEVEKIEQNGLALIQNKKEDVSSIVMSTLRELGQTWANLDHMVGQLKILLKSVLDQWSSHKVAFDKINSYLMEARYSLSRFRLLTGSLEAVQVQVDNLQNLQDDLEKQERSLQKFGSITNQLLKECHPPVTETLTNTLKEVNMRWNNLLEEIAEQLQSSKALLQLWQRYKDYSKQCASTVQQQEDRTNELLKAATNKDIADDEVATWIQDCNDLLKGLGTVKDSLFFLHELGEQLKQQVDASAASAIQSDQLSLSQHLCALEQALCKQQTSLQAGVLDYETFAKSLEALEAWIVEAEEILQGQDPSHSSDLSTIQERMEELKGQMLKFSSMAPDLDRLNELGYRLPLNDKEIKRMQNLNRHWSLISSQTTERFSKLQSFLLQHQTFLEKCETWMEFLVQTEQKLAVEISGNYQHLLEQQRAHELFQAEMFSRQQILHSIIIDGQRLLEQGQVDDRDEFNLKLTLLSNQWQGVIRRAQQRRGIIDSQIRQWQRYREMAEKLRKWLVEVSYLPMSGLGSVPIPLQQARTLFDEVQFKEKVFLRQQGSYILTVEAGKQLLLSADSGAEAALQAELAEIQEKWKSASMRLEEQKKKLAFLLKDWEKCEKGIADSLEKLRTFKKKLSQSLPDHHEELHAEQMRCKELENAVGSWTDDLTQLSLLKDTLSAYISADDISILNERVELLQRQWEELCHQLSLRRQQIGERLNEWAVFSEKNKELCEWLTQMESKVSQNGDILIEEMIEKLKKDYQEEIAIAQENKIQLQQMGERLAKASHESKASEIEYKLGKVNDRWQHLLDLIAARVKKLKETLVAVQQLDKNMSSLRTWLAHIESELAKPIVYDSCNSEEIQRKLNEQQELQRDIEKHSTGVASVLNLCEVLLHDCDACATDAECDSIQQATRNLDRRWRNICAMSMERRLKIEETWRLWQKFLDDYSRFEDWLKSSERTAAFPSSSGVIYTVAKEELKKFEAFQRQVHECLTQLELINKQYRRLARENRTDSACSLKQMVHEGNQRWDNLQKRVTSILRRLKHFIGQREEFETARDSILVWLTEMDLQLTNIEHFSECDVQAKIKQLKAFQQEISLNHNKIEQIIAQGEQLIEKSEPLDAAIIEEELDELRRYCQEVFGRVERYHKKLIRLPLPDDEHDLSDRELELEDSAALSDLHWHDRSADSLLSPQPSSNLSLSLAQPLRSERSGRDTPASVDSIPLEWDHDYDLSRDLESAMSRALPSEDEEGQDDKDFYLRGAVGLSDVMIPESPEAYVKLTENAIKNTSGDHSALESQIRQLGKALDDSRFQIQQTENIIRSKTPTGPELDTSYKGYMKLLGECSSSIDSVKRLEHKLKEEEESLPGFVNLHSTETQTAGVIDRWELLQAQALSKELRMKQNLQKWQQFNSDLNSIWAWLGDTEEELEQLQRLELSTDIQTIELQIKKLKELQKAVDHRKAIILSINLCSPEFTQADSKESRDLQDRLSQMNGRWDRVCSLLEEWRGLLQDALMQCQGFHEMSHGLLLMLENIDRRKNEIVPIDSNLDAEILQDHHKQLMQIKHELLESQLRVASLQDMSCQLLVNAEGTDCLEAKEKVHVIGNRLKLLLKEVSRHIKELEKLLDVSSSQQDLSSWSSADELDTSGSVSPTSGRSTPNRQKTPRGKCSLSQPGPSVSSPHSRSTKGGSDSSLSEPGPGRSGRGFLFRVLRAALPLQLLLLLLIGLACLVPMSEEDYSCALSNNFARSFHPMLRYTNGPPPL

SEQ ID NO: 1401 - protein, 349 aa, Human
MSKSKDDAPHELESQFILRLPPEYASTVRRAVQSGHVNLKDRLTIELHPDGRHGIVRVDRVPLASKLVDLPCVMESLKTIDKKTFYKTADICQMLVSTVDGDLYPPVEEPVASTDPKASKKKDKDKEKKFIWNHGITLPLKNVRKRRFRKTAKKKYIESPDVEKEVKRLLSTDAEAVSTRWEIIAEDETKEAENQGLDISSPGMSGHRQGHDSLEHDELREIFNDLSSSSEDEDETQHQDEEDINIIDTEEDLERQLQDKLNESDEQHQENEGTNQLVMGIQKQIDNMKGKLQETQDRAKRQEDLIMKVENLALKNRFQAVLDELKQKEDREKEQLSSLQEELESLLEK

SEQ ID NO: 1402 - protein, 345 aa, Human
MLAANPGKTPISLLQEYGTRIGKTPVYDLLKAEGQAHQPNFTFRVTVGDTSCTGQGPSKKAAKHKAAEVALKHLKGGSMLEPALEDSSSFSPLDSSLPEDIPVFTAAAAATPVPSVVLTRSPPMELQPPVSPQQSECNPVGALQELVVQKGWRLPEYTVTQESGPAHRKEFTMTCRVERFIEIGSGTSKKLAKRNAAAKMLLRVHTVPLDARDGNEVEPDDDHFSIGVGSRLDGLRNRGPGCTWDSLRNSVGEKILSLRSCSLGSLGALGPACCRVLSELSEEQAFHVSYLDIEELSLSGLCQCLVELSTQPATVCHGSATTREAARGEAARRALQYLKIMAGSK

SEQ ID NO: 1403 - protein, 958 aa, Human
MAEARKRRELLPLIYHHLLRAGYVRAAREVKEQSGQKCFLAQPVTLLDIYTHWQQTSELGRKRKAEEDAALQAKKTRVSDPISTSESSEEEEEAEAETAKATPRLASTNSSVLGADLPSSMKEKAKAETEKAGKTGNSMPHPATGKTVANLLSGKSPRKSAEPSANTTLVSETEEEGSVPAFGAAAKPGMVSAGQADSSSEDTSSSSDETDVEGKPSVKPAQVKASSVSTKESPARKAAPAPGKVGDVTPQVKGGALPPAKRAKKPEEESESSEEGSESEEEAPAGTRSQVKASEKILQVRAASAPAKGTPGKGATPAPPGKAGAVASQTKAGKPEEDSESSSEESSDSEEETPAAKALLQAKASGKTSQVGAASAPAKESPRKGAAPAPPGKTGPAVAKAQAGKREEDSQSSSEESDSEEEAPAQAKPSGKAPQVRAASAPAKESPRKGAAPAPPRKTGPAAAQVQVGKQEEDSRSSSEESDSDREALAAMNAAQVKPLGKSPQVKPASTMGMGPLGKGAGPVPPGKVGPATPSAQVGKWEEDSESSSEESSDSSDGEVPTAVAPAQEKSLGNILQAKPTSSPAKGPPQKAGPVAVQVKAEKPMDNSESSEESSDSADSEEAPAAMTAAQAKPALKIPQTKACPKKTNTTASAKVAPVRVGTQAPRKAGTATSPAGSSPAVAGGTQRPAEDSSSSEESDSEEEKTGLAVTVGQAKSVGKGLQVKAASVPVKGSLGQGTAPVLPGKTGPTVTQVKAEKQEDSESSEEESDSEEAAASPAQVKTSVKKTQAKANPAAARAPSAKGTISAPGKVVTAAAQAKQRSPSKVKPPVRNPQNSTVLARGPASVPSVGKAVATAAQAQTGPEEDSGSSEEESDSEEEAETLAQVKPSGKTHQIRAALAPAKESPRKGAAPTPPGKTGPSAAQAGKQDDSGSSSEESDSDGEAPAAVTSAQDQESS

SEQ ID NO: 1404 - protein, 235 aa, Human
MDPARPLGLSILLLFLTEAALGDAAQEPTGNNAEICLLPLDYGPCRALLLRYYYDRYTQSCRQFLYGGCEGNANNFYTWEACDDACWRIEKVPKVCRLQVSVDDQCEGSTEKYFFNLSSMTCEKFFSGGCHRNRIENRFPDEATCMGFCAPKKIPSFCYSPKDEGLCSANVTRYYFNPRYRTCDAFTYTGCGGNDNNFVSREDCKRACAKALKKKKKMPKLRFASRIRKIRKKQF

SEQ ID NO: 1405 - protein, 198 aa, Human
MATLWGGLLRLGSLLSLSCLALSVLLLAQLSDAAKNFEDVRCKCICPPYKENSGHIYNKNISQKDCDCLHVVEPMPVRGPDVEAYCLRCECKYEERSSVTIKVTIIIYLSILGLLLLYMVYLTLVEPILKRRLFGHAQLIQSDDDIGDHQPFANAHDVLARSRSRANVLNKVEYAQQRWKLQVQEQRKSVFDRHVVLS

SEQ ID NO: 1406 - protein, 465 aa, Human
MKEPDAIKLFVGQIPRHLEEKDLKPIFEQFGRIFELTVIKDKYTGLHKGCAFLTYCARDSALKAQSALHEQKTLPGMNRPIQVKPADSESRGEDRKLFVGMLGKQQTDEDVRKMFEPFGTIDECTVLRGPDGTSKGCAFVKFQTHAEAQAAINTLHSSRTLPGASSSLVVKFADTEKERGLRRMQQVATQLGMFSPIALQFGAYSAYTQALMQQQAALVAAHSAYLSPMATMAAVQMQHMAAINANGLIATPITPSSGTSTPPAIAATPVSAIPAALGVNGYSPVPTQPTGQPAPDALYPNGVHPYPAQSPAAPVDPLQQAYAGMQHYTAAYPAAYSLVAPAFPQPPALVAQQPPPPPQQQQQQQQQQQQQQQREGPDGCNIFIYHLPQEFTDSEILQMFVPFGHVISAKVFVDRATNQSKCFGFVSFDNPASAQAAIQAMNGFQIGMKRLKVQLKRPKDANRPY

SEQ ID NO: 1407 - protein, 835 aa, Human
MAASAAAASAAAASAASGSPGPGEGSAGGEKRSTAPSAAASASASAAASSPAGGGAEALELLEHCGVCRERLRPEREPRLLPCLHSACSACLGPAAPAAANSSGDGGAAGDGTVVDCPVCKQQCFSKDIVENYFMRDSGSKAATDAQDANQCCTSCEDNAPATSYCVECSEPLCETCVEAHQRVKYTKDHTVRSTGPAKSRDGERTVYCNVHKHEPLVLFCESCDTLTCRDCQLNAHKDHQYQFLEDAVRNQRKLLASLVKRLGDKHATLQKSTKEVRSSIRQVSDVQKRVQVDVKMAILQIMKELNKRGRVLVNDAQKVTEGQQERLERQHWTMTKIQKHQEHILRFASWALESDNNTALLLSKKLIYFQLHRALKMIVDPVEPHGEMKFQWDLNAWTKSAEAFGKIVAERPGTNSTGPAPMAPPRAPGPLSKQGSGSSQPMEVQEGYGFGSGDDPYSSAEPHVSGVKRSRSGEGEVSGLMRKVPRVSLERLDLDLTADSQPPVFKVFPGSTTEDYNLIVIERGAAAAATGQPGTAPAGTPGAPPLAGMAIVKEEETEAAIGAPPTATEGPETKPVLMALAEGPGAEGPRLASPSGSTSSGLEVVAPEGTSAPGGGPGTLDDSATICRVCQKPGDLVMCNQCEFCFHLDCHLPALQDVPGEEWSCSLCHVLPDLKEEDGSLSLDGADSTGVVAKLSPANQRKCERVLLALFCHEPCRPLHQLATDSTFSLDQPGGTLDLTLIRARLQEKLSPPYSSPQEFAQDVGRMFKQFNKLTEDKADVQSIIGLQRFFETRMNEAFGDTKFSAVLVEPPPMSLPGAGLSSQELSGGPGDGP

SEQ ID NO: 1408 - protein, 3097 aa, Human
MSGSSGGAAAPAASSGPAAAASAAGSGCGGGAGEGAEEAAKDLADIAAFFRSGFRKNDEMKAMDVLPILKEKVAYLSGGRDKRGGPILTFPARSNHDRIRQEDLRRLISYLACIPSEEVCKRGFTVIVDMRGSKWDSIKPLLKILQESFPCCIHVALIIKPDNFWQKQRTNFGSSKFEFETNMVSLEGLTKVVDPSQLTPEFDGCLEYNHEEWIEIRVAFEDYISNATHMLSRLEELQDILAKKELPQDLEGARNMIEEHSQLKKKVIKAPIEDLDLEGQKLLQRIQSSESFPKKNSGSGNADLQNLLPKVSTMLDRLHSTRQHLHQMWHVRKLKLDQCFQLRLFEQDAEKMFDWITHNKGLFLNSYTEIGTSHPHAMELQTQHNHFAMNCMNVYVNINRIMSVANRLVESGHYASQQIRQIASQLEQEWKAFAAALDERSTLLDMSSIFHQKAEKYMSNVDSWCKACGEVDLPSELQDLEDAIHHHQGIYEHITLAYSEVSQDGKSLLDKLQRPLTPGSSDSLTASANYSKAVHHVLDVIHEVLHHQRQLENIWQHRKVRLHQRLQLCVFQQDVQQVLDWIENHGEAFLSKHTGVGKSLHRARALQKRHEDFEEVAQNTYTNADKLLEAAEQLAQTGECDPEEIYQAAHQLEDRIQDFVRRVEQRKILLDMSVSFHTHVKELWTWLEELQKELLDDVYAESVEAVQDLIKRFGQQQQTTLQVTVNVIKEGEDLIQQLRDSAISSNKTPHNSSINHIETVLQQLDEAQSQMEELFQERKIKLELFLQLRIFERDAIDIISDLESWNDELSQQMNDFDTEDLTIAEQRLQHHADKALTMNNLTFDVIHQGQDLLQYVNEVQASGVELLCDRDVDMATRVQDLLEFLHEKQQELDLAAEQHRKHLEQCVQLRHLQAEVKQVLGWIRNGESMLNAGLITASSLQEAEQLQREHEQFQHAIEKTHQSALQVQQKAEAMLQANHYDMDMIRDCAEKVASHWQQLMLKMEDRLKLVNASVAFYKTSEQVCSVLESLEQEYKREEDWCGGADKLGPNSETDHVTPMISKHLEQKEAFLKACTLARRNADVFLKYLHRNSVNMPGMVTHIKAPEQQVKNILNELFQRENRVLHYWTMRKRRLDQCQQYVVFERSAKQALEWIHDNGEFYLSTHTSTGSSIQHTQELLKEHEEFQITAKQTKERVKLLIQLADGFCEKGHAHAAEIKKCVTAVDKRYRDFSLRMEKYRTSLEKALGISSDSNKSSKSLQLDIIPASIPGSEVKLRDAAHELNEEKRKSARRKEFIMAELIQTEKAYVRDLRECMDTYLWEMTSGVEEIPPGIVNKELIIFGNMQEIYEFHNNIFLKELEKYEQLPEDVGHCFVTWADKFQMYVTYCKNKPDSTQLILEHAGSYFDEIQQRHGLANSISSYLIKPVQRITKYQLLLKELLTCCEEGKGEIKDGLEVMLSVPKRANDAMHLSMLEGFDENIESQGELILQESFQVWDPKTLIRKGRERHLFLFEMSLVFSKEVKDSSGRSKYLYKSKLFTSELGVTEHVEGDPCKFALWVGRTPTSDNKIVLKASSIENKQDWIKHIREVIQERTIHLKGALKEPIHIPKTAPATRQKGRRDGEDLDSQGDGSSQPDTISIASRTSQNTLDSDKLSGGCELTVVIHDFTACNSNELTIRRGQTVEVLERPHDKPDWCLVRTTDRSPAAEGLVPCGSLCIAHSRSSMEMEGIFNHKDSLSVSSNDASPPASVASLQPHMIGAQSSPGPKRPGNTLRKWLTSPVRRLSSGKADGHVKKLAHKHKKSREVRKSADAGSQKDSDDSAATPQDETVEERGRNEGLSSGTLSKSSSSGMQSCGEEEGEEGADAVPLPPPMAIQQHSLLQPDSQDDKASSRLLVRPTSSETPSAAELVSAIEELVKSKMALEDRPSSLLVDQGDSSSPSFNPSDNSLLSSSSPIDEMEERKSSSLKRRHYVLQELVETERDYVRDLGYVVEGYMALMKEDGVPDDMKGKDKIVFGNIHQIYDWHRDFFLGELEKCLEDPEKLGSLFVKHERRLHMYIAYCQNKPKSEHIVSEYIDTFFEDLKQRLGHRLQLTDLLIKPVQRIMKYQLLLKDFLKYSKKASLDTSELERAVEVMCIVPRRCNDMMNVGRLQGFDGKIVAQGKLLLQDTFLVTDQDAGLLPRCRERRIFLFEQIVIFSEPLDKKKGFSMPGFLFKNSIKVSCLCLEENVENDPCKFALTSRTGDVVETFILHSSSPSVRQTWIHEINQILENQRNFLNALTSPIEYQRNHSGGGGGGGSGGSGGGGGSGGGGAPSGGSGHSGGPSSCGGAPSTSRSRPSRIPQPVRHHPPVLVSSAASSQAEADKMSGTSTPGPSLPPPGAAPEAGPSAPSRRPPGADAEGSEREAEPIPKMKVLESPRKGAANASGSSPDAPAKDARASLGTLPLGKPRAGAASPLNSPLSSAVPSLGKEPFPPSSPLQKGGSFWSSIPASPASRPGSFTFPGDSDSLQRQTPRHAAPGKDTDRMSTCSSASEQSVQSTQSNGSESSSSSNISTMLVTHDYTAVKEDEINVYQGEVVQILASNQQNMFLVFRAATDQCPAAEGWIPGFVLGHTSAVIVENPDGTLKKSTSWHTALRLRKKSEKKDKDGKREGKLENGYRKSREGLSNKVSVKLLNPNYIYDVPPEFVIPLSEVTCETGETVVLRCRVCGRPKASITWKGPEHNTLNNDGHYSISYSDLGEATLKIVGVTTEDDGIYTCIAVNDMGSASSSASLRVLGPGMDGIMVTWKDNFDSFYSEVAELGRGRFSVVKKCDQKGTKRAVATKFVNKKLMKRDQVTHELGILQSLQHPLLVGLLDTFETPTSYILVLEMADQGRLLDCVVRWGSLTEGKIRAHLGEVLEAVRYLHNCRIAHLDLKPENILVDESLAKPTIKLADFGDAVQLNTTYYIHQLLGNPEFAAPEIILGNPVSLTSDTWSVGVLTYVLLSGVSPFLDDSVEETCLNICRLDFSFPDDYFKGVSQKAKEFVCFLLQEDPAKRPSAALALQEQWLQAGNGRSTGVLDTSRLTSFIERRKHQNDVRPIRSIKNFLQSRLLPRV

SEQ ID NO: 1409 - protein, 444 aa, Human
MREIVHIQAGQCGNQIGAKFWEVISDEHGIDPTGTYHGDSDLQLDRISVYYNEATGGKYVPRAILVDLEPGTMDSVRSGPFGQIFRPDNFVFGQSGAGNNWAKGHYTEGAELVDSVLDVVRKEAESCDCLQGFQLTHSLGGGTGSGMGTLLISKIREEYPDRIMNTFSVVPSPKVSDTVVEPYNATLSVHQLVENTDETYCIDNEALYDICFRTLKLTTPTYGDLNHLVSATMSGVTTCLRFPGQLNADLRKLAVNMVPFPRLHFFMPGFAPLTSRGSQQYRALTVPELTQQVFDAKNMMAACDPRHGRYLTVAAVFRGRMSMKEVDEQMLNVQNKNSSYFVEWIPNNVKTAVCDIPPRGLKMAVTFIGNSTAIQELFKRISEQFTAMFRRKAFLHWYTGEGMDEMEFTEAESNMNDLVSEYQQYQDATAEEEEDFGEEAEEEA

SEQ ID NO: 1410 - protein, 445 aa, Human
MREIVHIQAGQCGNQIGAKFWEVISDEHGIDPTGSYHGDSDLQLERINVYYNEAAGNKYVPRAILVDLEPGTMDSVRSGPFGQIFRPDNFVFGQSGAGNNWAKGHYTEGAELVDSVLDVVRKESESCDCLQGFQLTHSLGGGTGSGMGTLLISKIREEYPDRIMNTFSVMPSPKVSDTVVEPYNATLSVHQLVENTDETYSIDNEALYDICFRTLKLTTPTYGDLNHLVSATMSGVTTCLRFPGQLNADLRKLAVNMVPFPRLHFFMPGFAPLTSRGSQQYRALTVPELTQQMFDSKNMMAACDPRHGRYLTVAAIFRGRMSMKEVDEQMLNVQNKNSSYFVEWIPNNVKTAVCDIPPRGLKMSATFIGNSTAIQELFKRISEQFTAMFRRKAFLHWYTGEGMDEMEFTEAESNMNDLVSEYQQYQDATADEQGEFEEEEGEDEA

SEQ ID NO: 1411 - protein, 666 aa, Human
MIHELLLALSGYPGSIFTWNKRSGLQVSQDFPFLHPSETSVLNRLCRLGTDYIRFTEFIEQYTGHVQQQDHHPSQQGQGGLHGIYLRAFCTGLDSVLQPYRQALLDLEQEFLGDPHLSISHVNYFLDQFQLLFPSVMVVVEQIKSQKIHGCQILETVYKHSCGGLPPVRSALEKILAVCHGVMYKQLSAWMLHGLLLDQHEEFFIKQGPSSGNVSAQPEEDEEDLGIGGLTGKQLRELQDLRLIEEENMLAPSLKQFSLRVEILPSYIPVRVAEKILFVGESVQMFENQNVNLTRKGSILKNQEDTFAAELHRLKQQPLFSLVDFEQVVDRIRSTVAEHLWKLMVEESDLLGQLKIIKDFYLLGRGELFQAFIDTAQHMLKTPPTAVTEHDVNVAFQQSAHKVLLDDDNLLPLLHLTIEYHGKEHKDATQAREGPSRETSPREAPASGWAALGLSYKVQWPLHILFTPAVLEKYNVVFKYLLSVRRVQAELQHCWALQMQRKHLKSNQTDAIKWRLRNHMAFLVDNLQYYLQVDVLESQFSQLLHQINSTRDFESIRLAHDHFLSNLLAQSFILLKPVFHCLNEILDLCHSFCSLVSQNLGPLDERGAAQLSILVKGFSRQSSLLFKILSSVRNHQINSDLAQLLLRLDYNKYYTQAGGTLGSFGM

SEQ ID NO: 1412 - protein, 405 aa, Human
MFVQEEKIFAGKVLRLHICASDGAEWLEEATEDTSVEKLKERCLKHCAHGSLEDPKSITHHKLIHAASERVLSDARTILEENIQDQDVLLLIKKRAPSPLPKMADVSAEEKKKQDQKAPDKEAILRATANLPSYNMDRAAVQTNMRDFQTELRKILVSLIEVAQKLLALNPDAVELFKKANAMLDEDEDERVDEAALRQLTEMGFPENRATKALQLNHMSVPQAMEWLIEHAEDPTIDTPLPGQAPPEAEGATAAASEAAAGASATDEEARDELTEIFKKIRRKREFRADARAVISLMEMGFDEKEVIDALRVNNNQQNAACEWLLGDRKPSPEELDKGIDPDSPLFQAILDNPVVQLGLTNPKTLLAFEDMLENPLNSTQWMNDPETGPVMLQISRIFQTLNRT

SEQ ID NO: 1413 - protein, 685 aa, Human
MQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPSDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGV

SEQ ID NO: 1414 - protein, 422 aa, Human
MQQPQPQGQQQPGPGQQLGGQGAAPGAGGGPGGGPGPGPCLRRELKLLESIFHRGHERFRIASACLDELSCEFLLAGAGGAGAGAAPGPHLPPRGSVPGDPVRIHCNITESYPAVPPIWSVESDDPNLAAVLERLVDIKKGNTLLLQHLKRIISDLCKLYNLPQHPDVEMLDQPLPAEQCTQEDVSSEDEDEEMPEDTEDLDHYEMKEEEPAEGKKSEDDGIGKENLAILEKIKKNQRQDYLNGAVSGSVQATDRLMKELRDIYRSQSFKGGNYAVELVNDSLYDWNVKLLKVDQDSALHNDLQILKEKEGADFILLNFSFKDNFPFDPPFVRVVSPVLSGGYVLGGGAICMELLTKQGWSSAYSIESVIMQISATLVKGKARVQFGANKSQYSLTRAQQSYKSLVQIHEKNGWYTPPKEDG

SEQ ID NO: 1415 - protein, 470 aa, Human
MKEEKEHRPKEKRVTLLTPAGATGSGGGTSGDSSKGEDKQDRNKEKKEALSKVVIRRLPPTLTKEQLQEHLQPMPEHDYFEFFSNDTSLYPHMYARAYINFKNQEDIILFRDRFDGYVFLDNKGQEYPAIVEFAPFQKAAKKKTKKRDTKVGTIDDDPEYRKFLESYATDNEKMTSTPETLLEEIEAKNRELIAKKTTPLLSFLKNKQRMREEKREERRRREIERKRQREEERRKWKEEEKRKRKDIEKLKKIDRIPERDKLKDEPKIKLLKKPEKGDEKELDKREKAKKLDKENLSDERASGQSCTLPKRSDSELKDEKPKRPEDESGRDYREREREYERDQERILRERERLKRQEEERRRQKERYEKEKTFKRKEEEMKKEKDTLRDKGKKAESTESIGSSEKTEKKEEVVKRDRIRNKDRPAMQLYQPGARSRNRLCPPDDSTKSGDSAAERKQESGISHRKEGGEE

SEQ ID NO: 1416 - protein, 310 aa, Human
MAATGANAEKAESHNDCPVRLLNPNIAKMKEDILYHFNLTTSRHNFPALFGDVKFVCVGGSPSRMKAFIRCVGAELGLDCPGRDYPNICAGTDRYAMYKVGPVLSVSHGMGIPSISIMLHELIKLLYYARCSNVTIIRIGTSGGIGLEPGTVVITEQAVDTCFKAEFEQIVLGKRVIRKTDLNKKLVQELLLCSAELSEFTTVVGNTMCTLDFYEGQGRLDGALCSYTEKDKQAYLEAAYAAGVRNIEMESSVFAAMCSACGLQAAVVCVTLLNRLEGDQISSPRNVLSEYQQRPQRLVSYFIKKKLSKA

SEQ ID NO: 1417 - protein, 445 aa, Human
MLPWTALGLALSLRLALARSGAERGPPASAPRGDLMFLLDSSASVSHYEFSRVREFVGQLVAPLPLGTGALRASLVHVGSRPYTEFPFGQHSSGEAAQDAVRASAQRMGDTHTGLALVYAKEQLFAEASGARPGVPKVLVWVTDGGSSDPVGPPMQELKDLGVTVFIVSTGRGNFLELSAAASAPAEKHLHFVDVDDLHIIVQELRGSILDAMRPQQLHATEITSSGFRLAWPPLLTADSGYYVLELVPSAQPGAARRQQLPGNATDWIWAGLDPDTDYDVALVPESNVRLLRPQILRVRTRPGEAGPGASGPESGAGPAPTQLAALPAPEEAGPERIVISHARPRSLRVSWAPALGSAAALGYHVQFGPLRGGEAQRVEVPAGRNCTTLQGLAPGTAYLVTVTAAFRSGRESALSAKACTPDGPRPRPRPVPRAPTPGTASREP

SEQ ID NO: 1418 - protein, 404 aa, Human
MEAGEEPLLLAELKPGRPHQFDWKSSCETWSVAFSPDGSWFAWSQGHCIVKLIPWPLEEQFIPKGFEAKSRSSKNETKGRGSPKEKTLDCGQIVWGLAFSPWPSPPSRKLWARHHPQVPDVSCLVLATGLNDGQIKIWEVQTGLLLLNLSGHQDVVRDLSFTPSGSLILVSASRDKTLRIWDLNKHGKQIQVLSGHLQWVYCCSISPDCSMLCSAAGEKSVFLWSMRSYTLIRKLEGHQSSVVSCDFSPDSALLVTASYDTNVIMWDPYTGERLRSLHHTQVDPAMDDSDVHISSLRSVCFSPEGLYLATVADDRLLRIWALELKTPIAFAPMTNGLCCTFFPHGGVIATGTRDGHVQFWTAPRVLSSLKHLCRKALRSFLTTYQVLALPIPKKMKEFLTYRTF

SEQ ID NO: 1419 - protein, 810 aa, Human
MPNQGEDCYFFFYSTCTKGDSCPFRHCEAAIGNETVCTLWQEGRCFRQVCRFRHMEIDKKRSEIPCYWENQPTGCQKLNCAFHHNRGRYVDGLFLPPSKTVLPTVPESPEEEVKASQLSVQQNKLSVQSNPSPQLRSVMKVESSENVPSPTHPPVVINAADDDEDDDDQFSEEGDETKTPTLQPTPEVHNGLRVTSVRKPAVNIKQGECLNFGIKTLEEIKSKKMKEKSKKQGEGSSGVSSLLLHPEPVPGPEKENVRTVVRTVTLSTKQGEEPLVRLSLTERLGKRKFSAGGDSDPPLKRSLAQRLGKKVEAPETNIDKTPKKAQVSKSLKERLGMSADPDNEDATDKVNKVGEIHVKTLEEILLERASQKRGELQTKLKTEGPSKTDDSTSGARSSSTIRIKTFSEVLAEKKHRQQEAERQKSKKDTTCIKLKIDSEIKKTVVLPPIVASRGQSEEPAGKTKSMQEVHIKTLEEIKLEKALRVQQSSESSTSSPSQHEATPGARRLLRITKRTGMKEEKNLQEGNEVDSQSSIRTEAKEASGETTGVDITKIQVKRCETMREKHMQKQQEREKSVLTPLRGDVASCNTQVAEKPVLTAVPGITRHLTKRLPTKSSQKVEVETSGIGDSLLNVKCAAQTLEKRGKAKPKVNVKPSVVKVVSSPKLAPKRKAVEMHAAVIAAVKPLSSSSVLQEPPAKKAAVAVVPLVSEDKSVTVPEAENPRDSLVLPPTQSSSDSSPPEVSGPSSSQMSMKTRRLSSASTGKPPLSVEDDFEKLIWEISGGKLEAEIDLDPGKDEDDLLLELSEMIDS

SEQ ID NO: 1420 - protein, 426 aa, Human
MPPKKQAQAGGSKKAEQKKKEKIIEDKTFGLKNKKGAKQQKFIKAVTHQVKFGQQNPRQVAQSEAEKKLKKDDKKKELQELNELFKPVVAAQKISKGADPKSVVCAFFKQGQCTKGDKCKFSHDLTLERKCEKRSVYIDARDEELEKDTMDNWDEKKLEEVVNKKHGEAEKKKPKTQIVCKHFLEAIENNKYGWFWVCPGGGDICMYRHALPPGFVLKKDKKKEEKEDEISLEDLIERERSALGPNVTKITLESFLAWKKRKRQEKIDKLEQDMERRKADFKAGKALVISGREVFEFRPELVNDDDEEADDTRYTQGTGGDEVDDSVSVNDIDLSLYIPRDVDETGITVASLERFSTYTSDKDENKLSEASGGRAENGERSDLEEDNEREGTENGAIDAVPVDENLFTGEDLDELEEELNTLDLEE

SEQ ID NO: 1421 - protein, 779 aa, Human
MAANGDSPPWSPALAAEGRGSSCEASVSFEDVTVDFSKEEWQHLDPAQRRLYWDVTLENYSHLLSVGYQIPKSEAAFKLEQGEGPWMLEGEAPHQSCSGEAIGKMQQQGIPGGIFFHCERFDQPIGEDSLCSILEELWQDNDQLEQRQENQNNLLSHVKVLIKERGYEHKNIEKIIHVTTKLVPSIKRLHNCDTILKHTLNSHNHNRNSATKNLGKIFGNGNNFPHSPSSTKNENAKTGANSCEHDHYEKHLSHKQAPTHHQKIHPEEKLYVCTECVMGFTQKSHLFEHQRIHAGEKSRECDKSNKVFPQKPQVDVHPSVYTGEKPYLCTQCGKVFTLKSNLITHQKIHTGQKPYKCSECGKAFFQRSDLFRHLRIHTGEKPYECSECGKGFSQNSDLSIHQKTHTGEKHYECNECGKAFTRKSALRMHQRIHTGEKPYVCADCGKAFIQKSHFNTHQRIHTGEKPYECSDCGKSFTKKSQLHVHQRIHTGEKPYICTECGKVFTHRTNLTTHQKTHTGEKPYMCAECGKAFTDQSNLIKHQKTHTGEKPYKCNGCGKAFIWKSRLKIHQKSHIGERHYECKDCGKAFIQKSTLSVHQRIHTGEKPYVCPECGKAFIQKSHFIAHHRIHTGEKPYECSDCGKCFTKKSQLRVHQKIHTGEKPNICAECGKAFTDRSNLITHQKIHTREKPYECGDCGKTFTWKSRLNIHQKSHTGERHYECSKCGKAFIQKATLSMHQIIHTGKKPYACTECQKAFTDRSNLIKHQKMHSGEKRYKASD

SEQ ID NO: 1422 - protein, 576 aa, Human
MDDLKYGVYPLKEASGCPGAERNLLVYSYFEKETLTFRDVAIEFSLEEWECLNPAQQNLYMNVMLENYKNLVFLGVAVSKQDPVTCLEQEKEPWNMKRHEMVDEPPAMCSYFTKDLWPEQDIKDSFQQVILRRYGKCEHENLQLRKGSASVDEYKVHKEGYNELNQCLTTTQSKIFPCDKYVKVFHKFLNANRHKTRHTGKKPFKCKKCGKSFCMLLHLSQHKRIHIRENSYQCEECGKAFKWFSTLTRHKRIHTGEKPFKCEECGKAFKQSSTLTTHKIIHTGEKPYRCEECGKAFNRSSHLTTHKIIHTGEKPYKCEECGKAFNQSSTLSTHKFIHAGEKPYKCEECDKAFNRFSYLTKHKIIHTGEKSYKCEECGKGFNWSSTLTKHKRIHTGEKPYKCEVCGKAFNESSNLTTHKMIHTGEKPYKCEECGKAFNRSPQLTAHKIIHTGEKPYKCEECGKAFSQSSILTTHKRIHTGEKPYKCEECGKAFNRSSNLTKHKIIHTGEKSYKCEECGKAFNQSSTLTKHRKIHTRQKPYNCEECDNTFNQSSNLIKQNNSYWRETLQMSRMWESL

SEQ ID NO: 1423 - protein, 276 aa, Homo sapiens
MAPPPAPLLAPRPGETRPGCRKPGTVSFADVAVYFSPEEWGCLRPAQRALYRDVMQETYGHLGALGFPGPKPALISWMEQESEAWSPAAQDPEKGERLGGARRGDVPNRKEEEPEEVPRAKGPRKAPVKESPEVLVERNPDPAISVAPARAQPPKNAAWDPTTGAQPPAPIPSMDAQAGQRRHVCTDCGRRFTYPSLLVSHRRMHSGERPFPCPECGMRFKRKFAVEAHQWIHRSCSGGRRGRRPGIRAVPRAPVRGDRDPPVLFRHYPDIFEECG

SEQ ID NO: 1424 - protein, 730 aa, Homo sapiens
MAAGVEAAAEVAATEIKMEEESGAPGVPSGNGAPGPKGEGERPAQNEKRKEKNIKRGGNRFEPYANPTKRYRAFITNIPFDVKWQSLKDLVKEKVGEVTYVELLMDAEGKSRGCAVVEFKMEESMKKAAEVLNKHSLSGRPLKVKEDPDGEHARRAMQKVMATTGGMGMGPGGPGMITIPPSILNNPNIPNEIIHALQAGRLGSTVFVANLDYKVGWKKLKEVFSMAGVVVRADILEDKDGKSRGIGTVTFEQSIEAVQAISMFNGQLLFDRPMHVKMDERALPKGDFFPPERPQQLPHGLGGIGMGLGPGGQPIDANHLNKGIGMGNIGPAGMGMEGIGFGINKMGGMEGPFGGGMENMGRFGSGMNMGRINEILSNALKRGEIIAKQGGGGGGGSVPGIERMGPGIDRLGGAGMERMGAGLGHGMDRVGSEIERMGLVMDRMGSVERMGSGIERMGPLGLDHMASSIERMGQTMERIGSGVERMGAGMGFGLERMAAPIDRVGQTIERMGSGVERMGPAIERMGLSMERMVPAGMGAGLERMGPVMDRMATGLERMGANNLERMGLERMGANSLERMGLERMGANSLERMGPAMGPALGAGIERMGLAMGGGGGASFDRAIEMERGNFGGSFAGSFGGAGGHAPGVARKACQIFVRNLPFDFTWKMLKDKFNECGHVLYADIKMENGKSKGCGVVKFESPEVAERACRMMNGMKLSGREIDVRIDRNA

SEQ ID NO: 1425 - protein, 406 aa, Homo sapiens
MADPKYADLPGIARNEPDVYETSDLPEDDQAEFDAFAQELEELTSTSVEHIIVNPNAAYDKFKDKRVGTKGLDFSDRIGKTKRTGYESGEYEMLGEGLGVKETPQQKYQRLLHEVQELTTEVEKIKTTVKESATEEKLTPVLLAKQLAALKQQLVASHLEKLLGPDAAINLTDPDGALAKRLLLQLEATKNSKGGSGGKTTGTPPDSSLVTYELHSRPEQDKFSQAAKVAELEKRLTELETAVRCDQDAQNPLSAGLQGACLMETVELLQAKVSALDLAVLDQVEARLQSVLGKVNEIAKHKASVEDADTQSKVHQLYETIQRWSPIASTLPELVQRLVTIKQLHEQAMQFGQLLTHLDTTQQMIANSLKDNTTLLTQVQTTMRENLATVEGNFASIDERMKKLGK

SEQ ID NO: 1426 - protein, 534 aa, Homo sapiens
MFSWVSKDARRKKEPELFQTVAEGLRQLYAQKLLPLEEHYRFHEFHSPALEDADFDNKPMVLLVGQYSTGKTTFIRHLIEQDFPGMRIGPEPTTDSFIAVMHGPTEGVVPGNALVVDPRRPFRKLNAFGNAFLNRFMCAQLPNPVLDSISIIDTPGILSGEKQRISRGYDFAAVLEWFAERVDRIILLFDAHKLDISDEFSEVIKALKNHEDKIRVVLNKADQIETQQLMRVYGALMWSLGKIINTPEVVRVYIGSFWSHPLLIPDNRKLFEAEEQDLFKDIQSLPRNAALRKLNDLIKRARLAKVHAYIISSLKKEMPNVFGKESKKKELVNNLGEIYQKIEREHQISPGDFPSLRKMQELLQTQDFSKFQALKPKLLDTVDDMLANDIARLMVMVRQEESLMPSQVVKGGAFDGTMNGPFGHGYGEGAGEGIDDVEWVVGKDKPTYDEIFYTLSPVNGKITGANAKKEMVKSKLPNTVLGKIWKLADVDKDGLLDDEEFALANHLIKVKLEGHELPADLPPHLVPPSKRRHE

SEQ ID NO: 1427 - protein, 427 aa, Homo sapiens
MAVLAALLRSGARSRSPLLRRLVQEIRYVERSYVSKPTLKEVVIVSATRTPIGSFLGSLSLLPATKLGSIAIQGAIEKAGIPKEEVKEAYMGNVLQGGEGQAPTRQAVLGAGLPISTPCTTINKVCASGMKAIMMASQSLMCGHQDVMVAGGMESMSNVPYVMNRGSTPYGGVKLEDLIVKDGLTDVYNKIHMGSCAENTAKKLNIARNEQDAYAINSYTRSKAAWEAGKFGNEVIPVTVTVKGQPDVVVKEDEEYKRVDFSKVPKLKTVFQKENGTVTAANASTLNDGAAALVLMTADAAKRLNVTPLARIVAFADAAVEPIDFPIAPVYAASMVLKDVGLKKEDIAMWEVNEAFSLVVLANIKMLEIDPQKVNINGGAVSLGHPIGMSGARIVGHLTHALKQGEYGLASICNGGGGASAMLIQKL

SEQ ID NO: 1428 - protein, 180 aa, Homo sapiens
MASTSYDYCRVPMEDGDKRCKLLLGIGILVLLIIVILGVPLIIFTIKANSEACRDGLRAVMECRNVTHLLQQELTEAQKGFQDVEAQAATCNHTVMALMASLDAEKAQGQKKVEELEGEITTLNHKLQDASAEVERLRRENQVLSVRIADKKYYPSSQDSSSAAAPQLLIVLLGLSALLQ

SEQ ID NO: 1429 - protein, 114 aa, Homo sapiens
MGPRRRSRKPEAPRRRSPSPTPTPGPSRRGPSLGASSHQHSRRRQGWLKEIRKLQKSTHLLIRKLPFSRLAAEAFLVHLFEDAYLLTLHAGRVTLFPKDVQLARRIRGLEEGLG

SEQ ID NO: 1430 - protein, 795 aa, Homo sapiens
MSKRHRLDLGEDYPSGKKRAGTDGKDRDRDRDREDRSKDRDRERDRGDREREREKEKEKELRASTNAMLISAGLPPLKASHSAHSTHSAHSTHSTHSAHSTHAGHAGHTSLPQCINPFTNLPHTPRYYDILKKRLQLPVWEYKDRFTDILVRHQSFVLVGETGSGKTTQIPQWCVEYMRSLPGPKRGVACTQPRRVAAMSVAQRVADEMDVMLGQEVGYSIRFEDCSSAKTILKYMTDGMLLREAMNDPLLERYGVIILDEAHERTLATDILMGVLKEVVRQRSDLKVIVMSATLDAGKFQIYFDNCPLLTIPGRTHPVEIFYTPEPERDYLEAAIRTVIQIHMCEEEEGDLLLFLTGQEEIDEACKRIKREVDDLGPEVGDIKIIPLYSTLPPQQQQRIFEPPPPKKQNGAIGRKVVVSTNIAETSLTIDGVVFVIDPGFAKQKVYNPRIRVESLLVTAISKASAQQRAGRAGRTRPGKCFRLYTEKAYKTEMQDNTYPEILRSNLGSVVLQLKKLGIDDLVHFDFMDPPAPETLMRALELLNYLAALNDDGDLTELGSMMAEFPLDPQLAKMVIASCDYNCSNEVLSITAMLSVPQCFVRPTEAKKAADEAKMRFAHIDGDHLTLLNVYHAFKQNHESVQWCYDNFINYRSLMSADNVRQQLSRIMDRFNLPRRSTDFTSRDYYINIRKALVTGYFMQVAHLERTGHYLTVKDNQVVQLHPSTVLDHKPEWVLYNEFVLTTKNYIRTCTDIKPEWLVKIAPQYYDMSNFPQCEAKRQLDRIIAKLQSKEYSQY

SEQ ID NO: 1431 - protein, 1037 aa, Homo sapiens
MDRMASSMKQVPNPLPKVLSRRGVGAGLEAAERESFERTQTVSINKAINTQEVAVKEKHARTCILGTHHEKGAQTFWSVVNRLPLSSNAVLCWKFCHVFHKLLRDGHPNVLKDSLRYRNELSDMSRMWGHLSEGYGQLCSIYLKLLRTKMEYHTKNPRFPGNLQMSDRQLDEAGESDVNNFFQLTVEMFDYLECELNLFQTVFNSLDMSRSVSVTAAGQCRLAPLIQVILDCSHLYDYTVKLLFKLHSCLPADTLQGHRDRFMEQFTKLKDLFYRSSNLQYFKRLIQIPQLPENPPNFLRASALSEHISPVVVIPAEASSPDSEPVLEKDDLMDMDASQQNLFDNKFDDIFGSSFSSDPFNFNSQNGVNKDEKDHLIERLYREISGLKAQLENMKTESQRVVLQLKGHVSELEADLAEQQHLRQQAADDCEFLRAELDELRRQREDTEKAQRSLSEIERKAQANEQRYSKLKEKYSELVQNHADLLRKNAEVTKQVSMARQAQVDLEREKKELEDSLERISDQGQRKTQEQLEVLESLKQELATSQRELQVLQGSLETSAQSEANWAAEFAELEKERDSLVSGAAHREEELSALRKELQDTQLKLASTEESMCQLAKDQRKMLLVGSRKAAEQVIQDALNQLEEPPLISCAGSADHLLSTVTSISSCIEQLEKSWSQYLACPEDISGLLHSITLLAHLTSDAIAHGATTCLRAPPEPADSLTEACKQYGRETLAYLASLEEEGSLENADSTAMRNCLSKIKAIGEELLPRGLDIKQEELGDLVDKEMAATSAAIETATARIEEMLSKSRAGDTGVKLEVNERILGCCTSLMQAIQVLIVASKDLQREIVESGRGTASPKEFYAKNSRWTEGLISASKAVGWGATVMVDAADLVVQGRGKFEELMVCSHEIAASTAQLVAASKVKADKDSPNLAQLQQASRGVNQATAGVVASTISGKSQIEETDNMDFSSMTLTQIKRQEMDSQVRVLELENELQKERQKLGELRKKHYELAGVAEGWEEGTEASPPTLQEVVTEKE

SEQ ID NO: 1432 - protein, 102 aa, Homo sapiens
MAGQAFRKFLPLFDRVLVERSAAETVTKGGIMLPEKSQGKVLQATVVAVGSGSKGKGGEIQPVSVKVGDKVLLPEYGGTKVVLDDKDYFLFRDGDILGKYVD

SEQ ID NO: 1433 - protein, 500 aa, Homo sapiens
MATAASNPYLPGNSLLAAGSIVHSDAAGAGGGGGGGGGGGGGGAGGGGGGMQPGSAAVTSGAYRGDPSSVKMVQSDFMQGAMAASNGGHMLSHAHQWVTALPHAAAAAAAAAAAAVEASSPWSGSAVGMAGSPQQPPQPPPPPPQGPDVKGGAGRDDLHAGTALHHRGPPHLGPPPPPPHQGHPGGWGAAAAAAAAAAAAAAAAHLPSMAGGQQPPPQSLLYSQPGGFTVNGMLSAPPGPGGGGGGAGGGAQSLVHPGLVRGDTPELAEHHHHHHHHAHPHPPHPHHAQGPPHHGGGGGGAGPGLNSHDPHSDEDTPTSDDLEQFAKQFKQRRIKLGFTQADVGLALGTLYGNVFSQTTICRFEALQLSFKNMCKLKPLLNKWLEEADSSTGSPTSIDKIAAQGRKRKKRTSIEVSVKGALESHFLKCPKPSAQEITNLADSLQLEKEVVRVWFCNRRQKEKRMTPPGIQQQTPDDVYSQVGTVSADTPPPHHGLQTSVQ

SEQ ID NO: 1434 - protein, 294 aa, Homo sapiens
MQPRRQRLPAPWSGPRGPRPTAPLLALLLLLAPVAAPAGSGDPDDPGQPQDAGVPRRLLQQAARAALHFFNFRSGSPSALRVLAEVQEGRAWINPKEGCKVHVVFSTERYNPESLLQEGEGRLGKCSARVFFKNQKPRPTINVTCTRLIEKKKRQQEDYLLYKQMKQLKNPLEIVSIPDNHGHIDPSLRLIWDLAFLGSSYVMWEMTTQVSHYYLAQLTSVRQWKTNDDTIDFDYTVLLHELSTQEIIPCRIHLVWYPGKPLKVKYHCQELQTPEEASGTEEGSAVVPTELSNF

SEQ ID NO: 1435 - protein, 165 aa, Homo sapiens [sequence omitted]

SEQ ID NO: 1436 - protein, 282 aa, Homo sapiens
MAVPETRPNHTIYINNLNEKIKKDELKKSLYAIFSQFGQILDILVSRSLKMRGQAFVIFKEVSSATNALRSMQGFPFYDKPMRIQYAKTDSDIIAKMKGTFVERDRKREKRKPKSQETPATKKAVQGGGATPVVGAVQGPVPGMPPMTQAPRIMHHMPGQPPYMPPPGMIPPPGLAPGQIPPGAMPPQQLMPGQMPPAQPLSENPPNHILFLTNLPEETNELMLSMLFNQFPGFKEVRLVPGRHDIAFVEFDNEVQAGAARDALQGFKITQNNAMKISFAKK

SEQ ID NO: 1437 - protein, 159 aa, Homo sapiens
MPKFYCDYCDTYLTHDSPSVRKTHCSGRKHKENVKDYYQKWMEEQAQSLIDKTTAAFQQGKIPPTPFSAPPPAGAMIPPPPSLPGPPRPGMMPAPHMGGPPMMPMMGPPPPGMMPVGPAPGMRPPMGGHMPMMPGPPMMRPPARPMMVPTRPGMTRPDR

SEQ ID NO: 1438 - protein, 214 aa, Homo sapiens
MNGDDAFARRPTVGAQIPEKIQKAFDDIAKYFSKEEWEKMKASEKIFYVYMKRKYEAMTKLGFKATLPPFMCNKRAEDFQGNDLDNDPNRGNQVERPQMTFGRLQGISPKIMPKKPAEEGNDSEEVPEASGPQNDGKELCPPGKPTTSEKIHERSGNREAQEKEERRGTAHRWSSQNTHNIGPKRGEHAWTHRLRERKQLVIYEEISDPEEDDE

SEQ ID NO: 1439 - protein, 759 aa, Homo sapiens
MEAVIEKECSALGGLFQTIISDMKGSYPVWEDFINKAGKLQSQLRTTVVAAAAFLDAFQKVADMATNTRGGTREIGSALTRMCMRHRSIEAKLRQFSSALIDCLINPLQEQMEEWKKVANQLDKDHAKEYKKARQEIKKKSSDTLKLQKKAKKVDTLGRGDIQPQLDSALQDVNDKYLLLEETEKQAVRKALIEERGRFCTFISMLRPVIEEEISMLGEITHLQTISEDLKSLTMDPHKLPSSSEQVILDLKGSDYSWSYQTPPSSPSTTMSRKSSVCSSLNSVNSSDSRSSGSHSHSPSSHYRYRSSNLAQQAPVRLSSVSSHDSGFISQDAFQSKSPSPMPPEAPNQLSNGFSHYSLSSESHVGPTGAGLFPHCLPASRLLPRVTSVHLPDYAHYYTIGPGMFPSSQIPSWKDWAKPGPYDQPLVNTLQRRKEKREPDPNGGGPTTASGPPAAAEEAQRPRSMTVSAATRPGEEMEACEELALALSRGLQLDTQRSSRDSLQCSSGYSTQTTTPCCSEDTIPSQVSDYDYFSVSGDQEADQQEFDKSSTIPRNSDISQSYRRMFQAKRPASTAGLPTTLGPAMVTPGVATIRRTPSTKPSVRRGTIGAGPIPIKTPVIPVKTPTVPDLPGVLPAPPDGPEERGEHSPESPSVGEGPQGVTSMPSSMWSGQASVNPPLPGPKPSIPEEHRQAIPESEAEDQEREPPSATVSPGQIPESDPADLSPRDTPQGEDMLNAIRRGVKLKKTTTNDRSAPRFS

SEQ ID NO: 1440 - protein, 313 aa, Homo sapiens
MGAEASSSWCPGTALPEERLSVKRASEISGFLGQGSSGEAALDVLTHVLEGAGNKLTSSCGKPSSNRMSLQWTAVATFLYAEVFVVLLLCIPFISPKRWQKIFKSRLVELLVSYGNTFFVVLIVILVLLVIDAVREIRKYDDVTEKVNLQNNPGAMEHFHMKLFRAQRNLYIAGFSLLLSFLLRRLVTLISQQATLLASNEAFKKQAESASEAAKKYMEENDQLKKGAAVDGGKLDVGNAEVKLEEENRSLKADLQKLKDELASTKQKLEKAENQVLAMRKQSEGLTKEYDRLLEEHAKLQAAVDGPMDKKEE

SEQ ID NO: 1441 - protein, 565 aa, Homo sapiens
MEDSDSAAKQLGLAEAAAVAAAAAVAAAAAAAAGGEAEEPVLSRDEDSEEDADSEAERETPRVTAVAVMAAEPGHMDMGAEALPGPDEAAAAAAFAEVTTVTVANVGAAADNVFTTSVANAASISGHVLSGRTALQIGDSLNTEKATLIVVHTDGSIVETTGLKGPAAPLTPGPQSPPTPLAPGQEKGGTKYNWDPSVYDSELPVRCRNISGTLYKNRLGSGGRGRCIKQGENWYSPTEFEAMAGRASSKDWKRSIRYAGRPLQCLIQDGILNPHAASCTCAACCDDMTLSGPVRLFVPYKRRKKENELPTTPVKKDSPKNITLLPATAATTFTVTPSGQITTSGALTFDRASTVEATAVISESPAQGDVFAGATVQEASVQPPCRASHPEPHYPGYQDSCQIAPFPEAALPTSHPKIVLTSLPALAVPPPTPTKAAPPALVNGLELSEPRSWLYLEEMVNSLLNTAQQLKTLFEQAKHASTYREAATNQAKIHADAERKEQSCVNCGREAMSECTGCHKVNYCSTFCQRKDWKDHQHICGQSAAVTVQADEVHVAESVMEKVTV

SEQ ID NO: 1442 - protein, 203 aa, Homo sapiens
MGGSLRVAVLGAPGVGKTAIIRQFLFGDYPERHRPTDGPRLYRPAVLLDGAVYDLSIRDGDVAGPGSSPGGPEEWPDAKDWSLQDTDAFVLVYDICSPDSFDYVKALRQRIAETRPAGAPEAPILVVGNKRDRQRLRFGPRRALAALVRRGWRCGYLECSAKYNWHVLRLFRELLRCALVRARPAHPALRLQGALHPARCSLM

SEQ ID NO: 1443 - protein, 1069 aa, Homo sapiens
MVVPEKEQSWIPKIFKKKTCTTFIVDSTDPGGTLCQCGRPRTAHPAVAMEDAFGAAVVTVWDSDAHTTEKPTDAYGELDFTGAGRKHSNFLRLSDRTDPAAVYSLVTRTWGFRAPNLVVSVLGGSGGPVLQTWLQDLLRRGLVRAAQSTGAWIVTGGLHTGIGRHVGVAVRDHQMASTGGTKVVAMGVAPWGVVRNRDTLINPKGSFPARYRWRGDPEDGVQFPLDYNYSAFFLVDDGTHGCLGGENRFRLRLESYISQQKTGVGGTGIDIPVLLLLIDGDEKMLTRIENATQAQLPCLLVAGSGGAADCLAETLEDTLAPGSGGARQGEARDRIRRFFPKGDLEVLQAQVERIMTRKELLTVYSSEDGSEEFETIVLKALVKACGSSEASAYLDELRLAVAWNRVDIAQSELFRGDIQWRSFHLEASLMDALLNDRPEFVRLLISHGLSLGHFLTPMRLAQLYSAAPSNSLIRNLLDQASHSAGTKAPALKGGAAELRPPDVGHVLRMLLGKMCAPRYPSGGAWDPHPGQGFGESMYLLSDKATSPLSLDAGLGQAPWSDLLLWALLLNRAQMAMYFWEMGSNAVSSALGACLLLRVMARLEPDAEEAARRKDLAFKFEGMGVDLFGECYRSSEVRAARLLLRRCPLWGDATCLQLAMQADARAFFAQDGVQSLLTQKWWGDMASTTPIWALVLAFFCPPLIYTRLITFRKSEEEPTREELEFDMDSVINGEGPVGLTPGLYHLGRTVLCIDFMVFTVRLLHIFTVNKQLGPKIVIVSKMMKDVFFFLFFLGVWLVAYGVATEGLLRPRDSDFPSILRRVFYRPYLQIFGQIPQEDMDVALMEHSNCSSEPGFWAHPPGAQAGTCVSQYANWLVVLLLVIFLLVANILLVNLLIAMFSYTFGKVQGNSDLYWKAQRYRLIREFHSRPALAPPFIVISHLRLLLRQLCRRPRSPQPSSPALEHFRVYLSKEAERKLLTWESVHKENFLLARARDKRESDSERLKRTSQKVDLALKQLGHIREYEQRLKVLEREVQQCSRVLGWVAEALSRSALLPPGGPPPPDLPGSKD

SEQ ID NO: 1444 - protein, 199 aa, Homo sapiens
MENFRKVRSEEAPAGCGAEGGGPGSGPFADLAPGAVHMRVKEGSKIRNLMAFATASMAQPATRAIVFSGCGRATTKTVTCAEILKRRLAGLHQVTRLRYRSVREVWQSLPPGPTQGQTPGEPAASLSVLKNVPGLAILLSKDALDPRQPGYQPPNPHPGPSSPPAAPASKRSLGEPAAGEGSAKRSQPEPGVADEDQTA

SEQ ID NO: 1445 - protein, 228 aa, Homo sapiens
MSYAEKPDEITKDEWMEKLNNLHVQRADMNRLIMNYLVTEGFKEAAEKFRMESGIEPSVDLETLDERIKIREMILKGQIQEAIALINSLHPELLDTNRYLYFHLQQQHLIELIRQRETEAALEFAQTQLAEQGEESRECLTEMERTLALLAFDSPEESPFGDLLHTMQRQKVWSEVNQAVLDYENRESTPKLAKLLKLLLWAQNELDQKKVKYPKMTDLSKGVIEEPK

SEQ ID NO: 1446 - protein, 1132 aa, Homo sapiens
MGANASNYPHSCSPRVGGNSQAQQTFIGTSSYSQQGYGCESKLYSLDHGHEKPQDKKKRTSGLATLKKKFIKRRKSNRSADHAKQMRELLSGWDVRDVNALVEEYEGTSALKELSLQASLARPEARTLQKDMADLYEYKYCTDVDLIFQETCFPVHRAILAARCPFFKTLLSSSPEYGAEIIMDINTAGIDMPMFSALLHYLYTGEFGMEDSRFQNVDILVQLSEEFGTPNSLDVDMRGLFDYMCYYDVVLSFSSDSELVEAFGGNQNCLDEELKAHKAVISARSPFFRNLLQRRIRTGEEITDRTLRTPTRIILDESIIPKKYATVILHCMYTDVVDLSVLHCSPSVGSLSEVQALVAGKPNMTRAEEAMELYHIALFLEFNMLAQGCEDIIAESISLDTLIAILKWSSHPYGSKWVHRQALHFLCEEFSQVMTSDVFYELSKDHLLTAIQSDYLQASEQDILKYLIKWGEHQLMKRIADREPNLLSGTAHSVNKRGVKRRDLDMEELREILSSLLPFVRIEHILPINSEVLSDAMKRGLISTPPSDMLPTTEGGKSNAWLRQKNAGIYVRPRLFSPYVEEAKSVLDEMMVEQTDLVRLRMVRMSNVPDTLYMVNNAVPQCCHMISHQQISSNQSSPPSVVANEIPVPRLLIMKDMVRRLQELRHTEQVQRAYALNCGEGATVSYEIQIRVLREFGLADAAAELLQNPHKFFPDERFGDESPLLTMRQPGRCRVNSTPPAETMFTDLDSFVAFHPPLPPPPPPYHPPATPIHNQLKAGWKQRPPSQHPSRSFSYPCNHSLFHSRTAPKAGPPPVYLPSVKAAPPDCTSTAGLGRQTVAAAAATTTSTATAAAAAASEKQVRTQPVLNDLMPDIAVGVSTLSLKDRRLPELAVDTELSQSVSEAGPGPPQHLSCIPQRHTHTSRKKHTLEQKTDTRENPQEYPDFYDFSNAACRPSTPALSRRTPSPSQGGYFGPDLYSHNKASPSGLKSAYLPGQTSPKKQEEARREYPLSPDGHLHRQKNEPIHLDVVEQPPQRSDFPLAAPENASTGPAHVRGRTAVETDLTFGLTPNRPSLSACSSEAPEERSGRRLADSESLGHGAQRNTDLEREDSISRGRRSPSKPDFLYKKSAL

SEQ ID NO: 1447 - protein, 200 aa, Homo sapiens
MDDKKKKRSPKPCLAQPAQAPGTLRRVPVPTSHSGSLALGLPHLPSPKQRAKFKRVGKEKCRPVLAGGGSGSAGTPLQHSFLTEVTDVYEMEGGLLNLLNDFHSGRLQAFGKECSFEQLEHVREMQEKLARLHFSLDVCGEEEDDEEEEDGVTEGLPEEQKKTMADRNLDQLLSNLEDLSNSIQKLHLAENAEPEEQSAA

SEQ ID NO: 1448 - protein, 1094 aa, Homo sapiens
MAARQAVGSGAQETCGLDRILEALKLLLSPGGSGSSSLQVTKHDVLLATLKSNLSALEDKFLKDPQWKNLKLLRDEIADKAEWPQNSVDVTWSFTSQTLLLLLCLKETMIRLAANFNPGKPNPRTPEVAPALSPDALSISQQKTVQFVLQFVVTLGICPYLMPGVGVPLRYRTEFGAVVQDVVCFDAAPDATRRLYTSCKALLNVAQHTSLGSLIFCHHFGDIAAGLCQLGFCPTKRKLLTPAEEVLTEEERTLSRGALRDMLDQVYQPLAVRELLILQGGPPQSCTDVKTQMRCRAPAWLRRLCGQLLSERLMRPNGVQAVVRGILEGAGAGAAGGSDAEVTAADWKKCDLIAKILASCPQQSLSPENYYRDICPQVLDLFHFQDKLTARQFQRVATTTFITLSRERPHLAAKYLLQPVLAPLHRCLNTAELSESDMVPGTILVTEEELSRCIEDVFKVYVVGNEPLTVLMDSLLPVLGVLFLLYCFTKQSVSHIRSLCQEILLWILGKLERKKAIASLKGFAGLDKAVPSLHSLCQFRVATQGGIMITIKEAISDEDEDEALYQKVSSEQGRVEHLGDLLSHCQECGLAGDFFIFCLKELTHVASENETELKTEPFSSKSLLELEQHQTLLVEGQERKLLVLQLMAVLCERMSEQIFTNVTQVVDFVAATLQRACASLAHQAESTVESQTLSMSMGLVAVMLGGAVQLKSSDFAVLKQLLPLLEKVSNTYPDPVIQELAVDLRITISTHGAFATEAVSMAAQSTLNRKDLEGKIEEQQQTSHERPTDVAHSHLEQQQSHETAPQTGLQSNAPIIPQGVNEPSTTTSQKSGSVTTEQLQEVLLSAYDPQIPTRAAALRTLSHWIEQREAKALEMQEKLLKIFLENLEHEDTFVYLSAIQGVALLSDVYPEKILPDLLAQYDSSKDKHTPETRMKVGEVLMRIVRALGDMVSKYREPLIHTFLRGVRDPDGAHRASSLANLGELCQRLDFLLGSVVHEVTACLIAVAKTDGEVQVRRAAIHVVVLLLRGLSQKATEVLSAVLKDLYHLLKHVVCLEPDDVAKLHAQLALEELDDIMKNFLFPPQKLEKKIMVLP

SEQ ID NO: 1449 - protein, 205 aa, Homo sapiens
MAASTASHRPIKGILKNKTSTTSSMVASAEQPRGNVDEELSKKSQKWDEMNILATYHPADKDYGLMKIDEPSTPYHSMMGDDEDACSDTEATEAMAPDILARKLAAAEGLEPKYRIQEQESSGEEDSDLSPEEREKKRQFEMKRKLHYNEGLNIKLARQLISKDLHDDDEDEEMLETADGESMNTEESNQGSTPSDQQQNKLRSS

SEQ ID NO: 1450 - protein, 126 aa, Homo sapiens
MPEPAKSAPAPKKGSKKAVTKAQKKDGKKRKRSRKESYSIYVYKVLKQVHPDTGISSKAMGIMNSFVNDIFERIAGEASRLAHYNKRSTITSREIQTAVRLLLPGELAKHAVSEGTKAVTKYTSSK

SEQ ID NO: 1451 - protein, 530 aa, Homo sapiens
MTRDFKPGDLIFAKMKGYPHWPARVDEVPDGAVKPPTNKLPIFFFGTHETAFLGPKDIFPYSENKEKYGKPNKRKGFNEGLWEIDNNPKVKFSSQQAATKQSNASSDVEVEEKETSVSKEDTDHEEKASNEDVTKAVDITTPKAARRGRKRKAEKQVETEEAGVVTTATASVNLKVSPKRGRPAATEVKIPKPRGRPKMVKQPCPSESDIITEEDKSKKKGQEEKQPKKQPKKDEEGQKEEDKPRKEPDKKEGKKEVESKRKNLAKTGVTSTSDSEEEGDDQEGEKKRKGGRNFQTAHRRNMLKGQHEKEAADRKRKQEEQMETEQQNKDEGKKPEVKKVEKKRETSMDSRLQRIHAEIKNSLKIDNLDVNRCIEALDELASLQVTMQQAQKHTEMITTLKKIRRFKVSQVIMEKSTMLYNKFKNMFLVGEGDSVITQVLNKSLAEQRQHEEANKTKDQGKKGPNKKLEKEQTGSKTLNGGSDAQDGNQPQHNGESNEDSKDNHEASTKKKPSSEERETEISLKDSTLDN

SEQ ID NO: 1452 - protein, 385 aa, Homo sapiens
MSGSSGTPYLGSKISLISKAQIRYEGILYTIDTDNSTVALAKVRSFGTEDRPTDRPAPPREEIYEYIIFRGSDIKDITVCEPPKAQHTLPQDPAIVQSSLGSASASPFQPHVPYSPFRGMAPYGPLAASSLLSQQYAASLGLGAGFPSIPVGKSPMVEQAVQTGSADNLNAKKLLPGKGTTGTQLNGRQAQPSSKTASDVVQPAAVQAQGQVNDENRRPQRRRSGNRRTRNRSRGQNRPTNVKENTIKFEGDFDFESANAQFNREELDKEFKKKLNFKDDKAEKGEEKDLAVVTQSAEAPAEEDLLGPNCYYDKSKSFFDNISSELKTSSRRTTWAEERKLNTETFGVSGRFLRGRSSRGGFRGGRGNGTTRRNPTSHRAGTGRV

SEQ ID NO: 1453 - protein, 431 aa, Homo sapiens
MHVRSLRAAAPHSFVALWAPLFLLRSALADFSLDNEVHSSFIHRRLRSQERREMQREILSILGLPHRPRPHLQGKHNSAPMFMLDLYNAMAVEEGGGPGGQGFSYPYKAVFSTQGPPLASLQDSHFLTDADMVMSFVNLVEHDKEFFHPRYHHREFRFDLSKIPEGEAVTAAEFRIYKDYIRERFDNETFRISVYQVLQEHLGRESDLFLLDSRTLWASEEGWLVFDITATSNHWVVNPRHNLGLQLSVETLDGQSINPKLAGLIGRHGPQNKQPFMVAFFKATEVHFRSIRSTGSKQRSQNRSKTPKNQEALRMANVAENSSSDQRQACKKHELYVSFRDLGWQDWIIAPEGYAAYYCEGECAFPLNSYMNATNHAIVQTLVHFINPETVPKPCCAPTQLNAISVLYFDDSSNVILKKYRNMVVRACGCH

SEQ ID NO: 1454 - protein, 268 aa, Homo sapiens
MEVTGDAGVPESGEIRTLKPCLLRRNYSREQHGVAASCLEDLRSKACDILAIDKSLTPVTLVLAEDGTIVDDDDYFLCLPSNTKFVALASNEKWAYNNSDGGTAWISQESFDVDETDSGAGLKWKNVARQLKEDLSSIILLSEEDLQMLVDAPCSDLAQELRQSCATVQRLQHTLQQVLDQREEVRQSKQLLQLYLQALEKEGSLLSKQEESKAAFGEEVDAVDTGISRETSSDVALASHILTALREKQAPELSLSSQDLEVGGNQGH

SEQ ID NO: 1455 - protein, 1077 aa, Homo sapiens
MEPSLKYINKKFPNIDVRNSTQHLGPVHREKAEIIRFLTNYYQSFVDVMEFRDHVYELLNTIDACQCHFDINLNFDFTRSYLDLIVTYTSVILLLSRIEDRRILIGMYNCAHEMLHGHGDPSFARLGQMVLEYDHPLKKLTEEFGPHTKAVSGALLSLHFLFVRRNQGAEQWRSAQLLSLISNPPAMINPANSDTMACEYLSVEVMERWIIIGFLLCHGCLNSNSQCQKLWKLCLQGSLYITLIREDVLQVHKVTEDLFSSLKGYGKRVADIKESKEHVIANSGQFHCQRRQFLRMAVKELETVLADEPGLLGPKALFAFMALSFIRDEVTWLVRHTENVTKTKTPEDYADSSIAELLFLLEGIRSLVRRHIKVIQQYHLQYLARFDALVLSDIIQNLSVCPEEESIIMSSFVSILSSLNLKQVDNGEKFEFSGLRLDWFRLQAYTSVAKAPLHLHENPDLAKVMNLIVFHSRMLDSVEKLLVETSDLSTFCFHLRIFEKMFAMTLEESAMLRYAIAFPLICAHFVHCTHEMCPEEYPHLKNHGLHHCNSFLEELAKQTSNCVLEICAEQRNLSEQLLPKHCATTISKAKNKKTRKQRQTPRKGEPERDKPGAESHRKNRSIVTNMDKLHLNLTELALTMNHVYSFSVFEHTIFPSEYLSSHLEARLNRAIVWLAGYNATTQEIVRPSELLAGVKAYIGFIQSLAQFLGADASRVIRNALLQQTQPLDSCGEQTITTLYTNWYLESLLRQASSGTIILSPAMQAFVSLPREGEQNFSAEEFSDISEMRALAELLGPYGMKFLSENLMWHVTSQIVELKKLVVENMDILVQIRSNFSKPDLMASLLPQLTGAENVLKRMTIIGVILSFRAMAQEGLREVFSSHCPFLMGPIECLKEFVTPDTDIKVTLSIFELASAAGVGCDIDPALVAAIANLKADTSSPEEEYKVACLLLIFLAVSLPLLATDPSSFYSIEKDGYNNNIHCLTKAIIQVSAALFTLYNKNIETHLKEFLVVASVSLLQLGQETDKLKTRNRESISLLMRLVVEESSFLTLDMLESCFPYVLLRNAYREVSRAFHLN

SEQ ID NO: 1456 - protein, 304 aa, Homo sapiens
MMKKDALTLSLSEQVAAALKPAAAPPPTPLRADGAPSAAPPDGLLASPDLGLLKLASPELERLIIQSNGLVTTTPTSSQFLYPKVAASEEQEFAEGFVKALEDLHKQNQLGAGAAAAAAAAAAGGPSGTATGSAPPGELAPAAAAPEAPVYANLSSYAGGAGGAGGAATVAFAAEPVPFPPPPPPGALGPPRLAALKDEPQTVPDVPSFGESPPLSPIDMDTQERIKAERKRLRNRIAASKCRKRKLERISRLEEKVKTLKSQNTELASTASLLREQVAQLKQKVLSHVNSGCQLLPQHQVPAY

SEQ ID NO: 1457 - protein, 323 aa, Homo sapiens
MAYVPAPGYQPTYNPTLPYYQPIPGGLNVGMSVYIQGVASEHMKRFFVNFVVGQDPGSDVAFHFNPRFDGWDKVVFNTLQGGKWGSEERKRSMPFKKGAAFELVFIVLAEHYKVVVNGNPFYEYGHRLPLQMVTHLQVDGDLQLQSINFIGGQPLRPQGPPMMPPYPGPGHCHQQLNSLPTMEGPPTFNPPVPYFGRLQGGLTARRTIIIKGYVPPTGKSFAINFKVGSSGDIALHINPRMGNGTVVRNSLLNGSWGSEEKKITHNPFGPGQFFDLSIRCGLDRFKVYANGQHLFDFAHRLSAFQRVDTLEIQGDVTLSYVQI

SEQ ID NO: 1458 - protein, 943 aa, Homo sapiens
MARGSALPRRPLLCIPAVWAAAALLLSVSRTSGEVEVLDPNDPLGPLDGQDGPIPTLKGYFLNFLEPVNNITIVQGQTAILHCKVAGNPPPNVRWLKNDAPVVQEPRRIIIRKTEYGSRLRIQDLDTTDTGYYQCVATNGMKTITATGVLFVRLGPTHSPNHNFQDDYHEDGFCQPYRGIACARFIGNRTIYVDSLQMQGEIENRITAAFTMIGTSTHLSDQCSQFAIPSFCHFVFPLCDARSRTPKPRELCRDECEVLESDLCRQEYTIARSNPLILMRLQLPKCEALPMPESPDAANCMRIGIPAERLGRYHQCYNGSGMDYRGTASTTKSGHQCQPWALQHPHSHHLSSTDFPELGGGHAYCRNPGGQMEGPWCFTQNKNVRMELCDVPSCSPRDSSKMGILYILVPSIAIPLVIACLFFLVCMCRNKQKASASTPQRRQLMASPSQDMEMPLINQHKQAKLKEISLSAVRFMEELGEDRFGKVYKGHLFGPAPGEQTQAVAIKTLKDKAEGPLREEFRHEAMLRARLQHPNVVCLLGVVTKDQPLSMIFSYCSHGDLHEFLVMRSPHSDVGSTDDDRTVKSALEPPDFVHLVAQIAAGMEYLSSHHVVHKDLATRNVLVYDKLNVKISDLGLFREVYAADYYKLLGNSLLPIRWMAPEAIMYGKFSIDSDIWSYGVVLWEVFSYGLQPYCGYSNQDVVEMIRNRQVLPCPDDCPAWVYALMIECWNEFPSRRPRFKDIHSRLRAWGNLSNYNSSAQTSGASNTTQTSSLSTSPVSNVSNARYVGPKQKAPPFPQPQFIPMKGQIRPMVPPPQLYVPVNGYQPVPAYGAYLPNFYPVQIPMQMAPQQVPPQMVPKPSSHHSGSGSTSTGYVTTAPSNTSMADRAALLSEGADDTQNAPEDGAQSTVQEAEEEEEGSVPETELLGDCDTLQVDEAQVQLEA

SEQ ID NO: 1459 - protein, 419 aa, Homo sapiens
MHLLGFFSVACSLLAAALLPGPREAPAAAAAFESGLDLSDAEPDAGEATAYASKDLEEQLRSVSSVDELMTVLYPEYWKMYKCQLRKGGWQHNREQANLNSRTEETIKFAAAHYNTEILKSIDNEWRKTQCMPREVCIDVGKEFGVATNTFFKPPCVSVYRCGGCCNSEGLQCMNTSTSYLSKTLFEITVPLSQGPKPVTISFANHTSCRCMSKLDVYRQVHSIIRRSLPATLPQCQAANKTCPTNYMWNNHICRCLAQEDFMFSSDAGDDSTDGFHDICGPNKELDEETCQCVCRAGLRPASCGPHKELDRNSCQCVCKNKLFPSQCGANREFDENTCQCVCKRTCPRNQPLNPGKCACECTESPQKCLLKGKKFHHQTCSCYRRPCTNRQKACEPGFSYSEEVCRCVPSYWKRPQMS

SEQ ID NO: 1460 - protein, 713 aa, Homo sapiens
MGSAEMCRDLAPEVEKLLLQPSPYVRKKAILTAVHMIRKVPELSSVFLPPCAQLLHERHHGKAVGPPILCFRSMDRRIENRMGTPAHRRRVVHTHRHTRNRLSCPWPPPFTSPTLTPGILLGTITLITELCERSPAALRHFRKVVPQLVHILRTLVTMGYSTEHSISGVSDPFLQVQILRLLRILGRNHEESSETMNDLLAQVATNTDTSRNAGNAVLFETVLTIMDIRSAAGLRVLAVNILGRFLLNSDRNIRYVALTSLLRLVQSDHSAVQRHRPTVVECLRETDASLSRRALELSLALVNSSNVRAMMQELQAFLESCPPDLRADCASGILLAAERFAPTKRWHIDTILHVLTTAGTHVRDDAVANLTQLIGGAQELHAYSVRRLYNALAEDISQQPLVQVAAWCIGEYGDLLLAGNCEEIEPLQVDEEEVLALLEKVLQSHMSLPATRGYALTALMKLSTRLCGDNNRIRQVVSIYGSCLDVELQQRAVEYDTLFRKYDHMRAAILEKMPLVERDGPQADEEAKESKEAAQLSEAAPVPTEPQASQLLDLLDLLDGASGDVQHPPHLDPSPGGALVHLLDLPCVPPPPAPIPDLKVFEREGVQLNLSFIRPPENPALLLITITATNFSEGDVTHFICQAAVPKSLQLQLQAPSGNTVPARGGLPITQLFRILNPNKAPLRLKLRLTYDHFHQSVQEIFEVNNLPVESWQ

SEQ ID NO: 1461 - protein, 2303 aa, Homo sapiens
MASSVAPYEQLVRQVEALKAENSHLRQELRDNSSHLSKLETETSGMKEVLKHLQGKLEQEARVLVSSGQTEVLEQLKALQMDITSLYNLKFQPPTLGPEPAARTPEGSPVHGSGPSKDSFGELSRATIRLLEELDRERCFLLNEIEKEEKEKLWYYSQLQGLSKRLDELPHVETQFSMQMDLIRQQLEFEAQHIRSLMEERFGTSDEMVQRAQIRASRLEQIDKELLEAQDRVQQTEPQALLAVKSVPVDEDPETEVPTHPEDGTPQPGNSKVEVVFWLLSMLATRDQEDTARTLLAMSSSPESCVAMRRSGCLPLLLQILHGTEAAAGGRAGAPGAPGAKDARMRANAALHNIVFSQPDQGLARKEMRVLHVLEQIRAYCETCWDWLQARDGGPEGGGAGSAPIPIEPQICQATCAVMKLSFDEEYRRAMNELGGLQAVAELLQVDYEMHKMTRDPLNLALRRYAGMTLTNLTFGDVANKATLCARRGCMEAIVAQLASDSEELHQVVSSILRNLSWRADINSKKVLREAGSVTALVQCVLRATKESTLKSVLSALWNLSAHSTENKAAICQVDGALGFLVSTLTYKCQSNSLAIIESGGGILRNVSSLVATREDYRQVLRDHNCLQTLLQHLTSHSLTIVSNACGTLWNLSARSARDQELLWDLGAVGMLRNLVHSKHKMIAMGSAAALRNLLAHRPAKHQAAATAVSPGSCVPSLYVRKQRALEAELDARHLAQALEHLEKQGPPAAEAATKKPLPPLRHLDGLAQDYASDSGCFDDDDAPSSLAAAAATGEPASPAALSLFLGSPFLQGQALARTPPTRRGGKEAEKDTSGEAAVAAKAKAKLALAVARIDQLVEDISALHTSSDDSFSLSSGDPGQEAPREGRAQSCSPCRGPEGGRREAGSRAHPLLRLKAAHASLSNDSLNSGSASDGYCPREHMLPCPLAALASRREDPRCGQPRPSRLDLDLPGCQAEPPAREATSADARVRTIKLSPTYQHVPLLEGASRAGAEPLAGPGISPGARKQAWLPADHLSKVPEKLAAAPLSVASKALQKLAAQEGPLSLSRCSSLSSLSSAGRPGPSEGGDLDDSDSSLEGLEEAGPSEAELDSTWRAPGATSLPVAIPAPRRNRGRGLGVEDATPSSSSENYVQETPLVLSRCSSVSSLGSFESPSIASSIPSEPCSGQGSGTISPSELPDSPGQTMPPSRSKTPPLAPAPQGPPEATQFSLQWESYVKRFLDIADCRERCRLPSELDAGSVRFTVEKPDENFSCASSLSALALHEHYVQQDVELRLLPSACPERGGGAGGAGLHFAGHRRREEGPAPTGSRPRGAADQELELLRECLGAAVPARLRKVASALVPGRRALPVPVYMLVPAPAPAQEDDSCTDSAEGTPVNFSSAASLSDETLQGPPRDQPGGPAGRQRPTGRPTSARQAMGHRHKAGGAGRSAEQSRGAGKNRAGLELPLGRPPSAPADKDGSKPGRTRGDGALQSLCLTTPTEEAVYCFYGNDSDEEPPAAAPTPTHRRTSAIPRAFTRERPQGRKEAPAPSKAAPAAPPPARTQPSLIADETPPCYSLSSSASSLSEPEPSEPPAVHPRGREPAVTKDPGPGGGRDSSPSPRAAEELLQRCISSALPRRRPPVSGLRRRKPRATRLDERPAEGSRERGEEAAGSDRASDLDSVEWRAIQEGANSIVTWLHQAAAATREASSESDSILSFVSGLSVGSTLQPPKHRKGRQAEGEMGSARRPEKRGAASVKTSGSPRSPAGPEKPRGTQKTTPGVPAVLRGRTVIYVPSPAPRAQPKGTPGPRATPRKVAPPCLAQPAAPAKVPSPGQQRSRSLHRPAKTSELATLSQPPRSATPPARLAKTPSSSSSQTSPASQPLPRKRPPVTQAAGALPGPGASPVPKTPARTLLAKQHKTQRSPVRIPFMQRPARRGPPPLARAVPEPGPRGRAGTEAGPGARGGRLGLVRVASALSSGSESSDRSGFRRQLTFIKESPGLRRRRSELSSAESAASAPQGASPRRGRPALPAVFLCSSRCEELRAAPRQGPAPARQRPPAARPSPGERPARRTTSESPSRLPVRAPAARPETVKRYASLPHISVARRPDGAVPAAPASADAARRSSDGEPRPLPRVAAPGTTWRRIRDEDVPHILRSTLPATALPLRGSTPEDAPAGPPPRKTSDAVVQTEEVAAPKTNSSTSPSLETREPPGAPAGGQLSLLGSDVDGPSLAKAPISAPFVHEGLGVAVGGFPASRHGSPSRSARVPPFNYVPSPMVVAATTDSAAEKAPATASATLLE

SEQ ID NO: 1462 - protein, 541 aa, Homo sapiens
MSQLVECVPNFSEGKNQEVIDAISGAITQTPGCVLLDVDAGPSTNRTVYTFVGPPECVVEGALNAARVASRLIDMSRHQGEHPRMGALDVCPFIPVRGVSVDECVLCAQAFGQRLAEELDVPVYLYGEAARMDSRRTLPAIRAGEYEALPKKLQQADWAPDFGPSSFVPSWGATATGARKFLIAFNINLLGTKEQAHRIALNLREQGRGKDQPGRLKKVQGIGWYLDEKNLAQVSTNLLDFEVTALHTVYEETCREAQELSLPVVGSQLVGLVPLKALLDAAAFYCEKENLFILEEEQRIRLVVSRLGLDSLCPFSPKERIIEYLVPERGPERGLGSKSLRAFVGEVGARSAAPGGGSVAAAAAAMGAALGSMVGLMTYGRRQFQSLDTTMRRLIPPFREASAKLTTLVDADAEAFTAYLEAMRLPKNTPEEKDRRTAALQEGLRRAVSVPLTLAETVASLWPALQELARCGNLACRSDLQVAAKALEMGVFGAYFNVLINLRDITDEAFKDQIHHRVSSLLQEAKTQAALVLDCLETRQE

SEQ ID NO: 1463 - protein, 246 aa, Homo sapiens
MNDWMPIAKEYDPLKAGSIDGTDEDPHDRAVWRAMLARYVPNKGVIGDPLLTLFVARLNLQTKEDKLKEVFSRYGDIRRLRLVRDLVTGFSKGYAFIEYKEERAVIKAYRDADGLVIDQHEIFVDYELERTLKGWIPRRLGGGLGGKKESGQLRFGGRDRPFRKPINLPVVKNDLYREGKRERRERSRSRERHWDSRTRDRDHDRGREKRWQEREPTRVWPDNDWERERDFRDDRIKGREKKERGK

SEQ ID NO: 1464 - protein, 117 aa, Homo sapiens
MKWMFKEDHSLEHRCVESAKIRAKYPDRVPVIVEKVSGSQIVDIDKRKYLVPSDITVAQFMWIIRKRIQLPSEKAIFLFVDKTVPQSSLTMGQLYEKEKDEDGFLYVAYSGENTFGF

SEQ ID NO: 1465 - protein, 482 aa, Homo sapiens
MLFEGKVNPQTQSLLAECGEWTRRSLHLRVLGRQLILPTDKGVQHFQGSTPASAVHRPPLSACGHSSNIRELCISGSQIVPAALSASALPGPDDTGVADLTARSSLEEEVYHVDGKIEEYFAFDRKEDDDECLEQKPAQPGRKWRKLGLPPVSPRDCVKDAVAAEVFDHVWTNMVELLEELIRKHWETTLTEGKKQRETLKVAGNRFPHVLVPHAHADGASGPPSGHAEAHGISLASRLNPPQIHHFSSSFYSDMNGVMTIQAKPLQRRPAYFADRTQNEKEDKASGGGAGALSSAPHRLGRASDTHGLSPSAKKTPVPWRLPSLASDSQRLKTPNIYSDEVLRGTKLPTGVDHMASPLVQTSRSRFPPLVTETRGQNTAVPGCRLVSYRGRHLQNRVLSAMPDGTERSRLRERTATLERLSRPSTTHTFRQSDTPRKSSLTQMEFAAHTWTGQSILTGSQYVPKSFQRTTLTFKRRFQVTS

SEQ ID NO: 1466 - protein, 463 aa, Homo sapiens
MSGGTPYIGSKISLISKAEIRYEGILYTIDTENSTVALAKVRSFGTEDRPTDRPIPPRDEVFEYIIFRGSDIKDLTVCEPPKPQCSLPQDPAIVQSSLGSSTSSFQSMGSYGPFGRMPTYSQFSPSSLVGQQFGAVGVAGSSLTSFGTETSNSGTLPQSSAVGSAFTQDTRSLKTQLSQGRSSPQLDPLRKSPTMEQAVQTASAHLPAPAAVGRRSPVSTRPLPSASQKAGENQEHRRAEVHKVSRPENEQLRNDNKRQVAPGAPSAPRRGRGGHRGGRGRFGIRRDGPMKFEKDFDFESANAQFNKEEIDREFHNKLKLKEDKLEKQEKPVNGEDKGDSGVDTQNSEGNADEEDPLGPNCYYDKTKSFFDNISCDDNRERRPTWAEERRLNAETFGIPLRPNRGRGGYRGRGGLGFRGGRGRGGGRGGTFTAPRGFRGGFRGGRGGREFADFEYRKDNKVAA

SEQ ID NO: 1467 - protein, 178 aa, Homo sapiens
MSSFSRAPQQWATFARIWYLLDGKMQPPGKLAAMASIRLQGLHKPVYHALSDCGDHVVIMNTRHIAFSGNKWEQKVYSSHTGYPGGFRQVTAAQLHLRDPVAIVKLAIYGMLPKNLHRRTMMERLHLFPDEYIPEDILKNLVEELPQPRKIPKRLDEYTQEEIDAFPRLWTPPEDYRL

SEQ ID NO: 1468 - protein, 1176 aa, Homo sapiens
MAERKGTAKVDFLKKIEKEIQQKWDTERVFEVNASNLEKQTSKGKYFVTFPYPYMNGRLHLGHTFSLSKCEFAVGYQRLKGKCCLFPFGLHCTGMPIKACADKLKREIELYGCPPDFPDEEEEEEETSVKTEDIIIKDKAKGKKSKAAAKAGSSKYQWGIMKSLGLSDEEIVKFSEAEHWLDYFPPLAIQDLKRMGLKVDWRRSFITTDVNPYYDSFVRWQFLTLRERNKIKFGKRYTIYSPKDGQPCMDHDRQTGEGVGPQEYTLLKLKVLEPYPSKLSGLKGKNIFLVAATLRPETMFGQTNCWVRPDMKYIGFETVNGDIFICTQKAARNMSYQGFTKDNGVVPVVKELMGEEILGASLSAPLTSYKVIYVLPMLTIKEDKGTGVVTSVPSDSPDDIAALRDLKKKQALRAKYGIRDDMVLPFEPVPVIEIPGFGNLSAVTICDELKIQSQNDREKLAEAKEKIYLKGFYEGIMLVDGFKGQKVQDVKKTIQKKMIDAGDALIYMEPEKQVMSRSSDECVVALCDQWYLDYGEENWKKQTSQCLKNLETFCEETRRNFEATLGWLQEHACSRTYGLGTHLPWDEQWLIESLSDSTIYMAFYTVAHLLQGGNLHGQAESPLGIRPQQMTKEVWDYVFFKEAPFPKTQIAKEKLDQLKQEFEFWYPVDLRVSGKDLVPNHLSYYLYNHVAMWPEQSDKWPTAVRANGHLLLNSEKMSKSTGNFLTLTQAIDKFSADGMRLALADAGDTVEDANFVEAMADAGILRLYTWVEWVKEMVANWDSLRSGPASTFNDRVFASELNAGIIKTDQNYEKMMFKEALKTGFFEFQAAKDKYRELAVEGMHRELVFRFIEVQTLLLAPFCPHLCEHIWTLLGKPDSIMNASWPVAGPVNEVLIHSSQYLMEVTHDLRLRLKNYMMPAKGKKTDKQPLQKPSHCTIYVAKNYPPWQHTTLSVLRKHFEANNGKLPDNKVIASELGSMPELKKYMKKVMPFVAMIKENLEKMGPRILDLQLEFDEKAVLMENIVYLTNSLELEHIEVKFASEAEDKIREDCCPGKPLNVFRIEPGVSVSLVNPQPSNGHFSTKIEIRQGDNCDSIIRRLMKMNRGIKDLSKVKLMRFDDPLLGPRRVPVLGKEYTEKTPISEHAVFNVDLMSKKIHLTENGIRVDIGDTIIYLVH

SEQ ID NO: 1469 - protein, 1341 aa, Homo sapiens
MMNRTTPDQELAPASEPVWERPWSVEEIRRSSQSWSLAADAGLLQFLQEFSQQTISRTHEIKKQVDGLIRETKATDCRLHNVFNDFLMLSNTQFIENRVYDEEVEEPVLKAEAEKTEQEKTREQKEVDLIPKVQEAVNYGLQVLDSAFEQLDIKAGNSDSEEDDANGRVELILEPKDLYIDRPLPYLIGSKLFMEQEDVGLGELSSEEGSVGSDRGSIVDTEEEKEEEESDEDFAHHSDNEQNRHTTQMSDEEEDDDGCDLFADSEKEEEDIEDIEENTRPKRSRPTSFADELAARIKGDAVGRVDEEPTTLPSGEAKPRKTLKEKKERRTPSDDEEDNLFAPPKLTDEDFSPFGSGGGLFSGGKGLFDDEDEESDLFTEAPQDRQAGASVKEESSSSKPGKKIPAGAVSVFLGDTDVFGAASVPSMKEPQKPEQPTPRKSPYGPPPTGLFDDDDGDDDDDFFSAPHSKPSKTGKVQSTADIFGDEEGDLFKEKAVASPEATVSQTDENKARAEKKVTLSSSKNLKPSSETKTQKGLFSDEEDSEDLFSSQSASKLKGASLLPGKLPTLVSLFDDEDEEDNLFGGTAAKKQTLCLQAQREEKAKASELSKKKASALLFSSDEEDQWNIPASQTHLASDSRSKGEPRDSGTLQSQEAKAVKKTSLFEEDEEDDLFAIAKDSQKKTQRVSLLFEDDVDSGGSLFGSPPTSVPPATKKKETVSEAPPLLFSDEEEKEAQLGVKSVDKKVESAKESLKFGRTDVAESEKEGLLTRSAQETVKHSDLFSSSSPWDKGTKPRTKTVLSLFDEEEDKMEDQNIIQAPQKEVGKGRDPDAHPKSTGVFQDEELLFSHKLQKDNDPDVDLFAGTKKTKLLEPSVGSLFGDDEDDDLFSSAKSQPLVQEKKRVVKKDHSVDSFKNQKHPESIQGSKEKGIWKPETPQDSSGLAPFKTKEPSTRIGKIQANLAINPAALLPTAASQISEVKPVLPELAFPSSEHRRSHGLESVPVLPGSGEAGVSFDLPAQADTLHSANKSRVKMRGKRRPQTRAARRLAAQESSETEDMSVPRGPIAQWADGAISPNGHRPQLRAASGEDSTEEALAAAAAPWEGGPVPGVDRSPFAKSLGHSRGEADLFDSGDIFSTGTGSQSVERTKPKAKIAENPANPPVGGKAKSPMFPALGEASSDDDLFQSAKPKPAKKTNPFPLLEDEDDLFTDQKVKKNETKSNSQQDVILTTQDIFEDDIFATEAIKPSQKTREKEKTLESNLFDDNIDIFADLTVKPKEKSKKKVEAKSIFDDDMDDIFSSGIQAKTTKPKSRSAQAAPEPRFEHKVSNIFDDPLNAFGGQ

SEQ ID NO: 1470 - protein, 184 aa, Homo sapiens
MKPDETPMFDPSLLKEVDWSQNTATFSPAISPTHPGEGLVLRPLCTADLNRGFFKVLGQLTETGVVSPEQFMKSFEHMKKSGDYYVTVVEDVTLGQIVATATLIIEHKFIHSCAKRGRVEDVVVSDECRGKQLGKLLLSTLTLLSKKLNCYKITLECLPQNVGFYKKFGYTVSEENYMCRRFLK

SEQ ID NO: 1471 - protein, 442 aa, Homo sapiens
MGLAMEHGGSYARAGGSSRGCWYYLRYFFLFVSLIQFLIILGLVLFMVYGNVHVSTESNLQATERRAEGLYSQLLGLTASQSNLTKELNFTTRAKDAIMQMWLNARRDLDRINASFRQCQGDRVIYTNNQRYMAAIILSEKQCRDQFKDMNKSCDALLFMLNQKVKTLEVEIAKEKTICTKDKESVLLNKRVAEEQLVECVKTRELQHQERQLAKEQLQKVQALCLPLDKDKFEMDLRNLWRDSIIPRSLDNLGYNLYHPLGSELASIRRACDHMPSLMSSKVEELARSLRADIERVARENSDLQRQKLEAQQGLRASQEAKQKVEKEAQAREAKLQAECSRQTQLALEEKAVLRKERDNLAKELEEKKREAEQLRMELAIRNSALDTCIKTKSQPMMPVSRPMGPVPNPQPIDPASLEEFKRKILESQRPPAGIPVAPSSG

SEQ ID NO: 1472 - protein, 399 aa, Homo sapiens
MAVTMLQDWCRWMGVNARRGLLILGIPEDCDDAEFQESLEAALRPMGHFTVLGKVFREEDNATAALVELDREVNYALVPREIPGTGGPWNVVFVPRCSGEEFLGLGRVFHFPEQEGQMVESVAGALGVGLRRVCWLRSIGQAVQPWVEAVRYQSLGVFSGRDQPAPGEESFEVWLDHTTEMLHVWQGVSERERRRRLLEGLRGTALQLVHALLAENPARTAQDCLAALAQVFGDNESQATIRVKCLTAQQQSGERLSAFVLRLEVLLQKAMEKEALARASADRVRLRQMLTRAHLTEPLDEALRKLRMAGRSPSFLEMLGLVRESEAWEASLARSVRAQTQEGAGARAGAQAVARASTKVEAVPGGPGREPEGLRQAGGQEAEELLQEGLKPVLEECDN

SEQ ID NO: 1473 - protein, 90 aa, Homo sapiens
MKFLAVLVLLGVSIFLVSAQNPTTAAPADTYPATGPADDEAPDAETTAAATTATTAAPTTATTAASTTARKDIPVLPKWVGDLPNGRVCP

SEQ ID NO: 1474 - protein, 362 aa, Homo sapiens
MAEVPPGPSSLLPPPAPPAPAAVEPRCPFPAGAALACCSEDEEDDEEHEGGGSRSPAGGESATVAAKGHPCLRCPQPPQEQQQLNGLISPELRHLRAAASLKSKVLSVAEVAATTATPDGGPRATATKGAGVHSGERPPHSLSSNARTAVPSPVEAAAASDPAAARNGLAEGTEQEEEEEDEQVRLLSSSLTADCSLRSPSGREVEPGEDRTIRYVRYESELQMPDIMRLITKDLSEPYSIYTYRYFIHNWPQLCFLAMVGEECVGAIVCKLDMHKKMFRRGYIAMLAVDSKYRRNGIGTNLVKKAIYAMVEGDCDEVVLETEITNKSALKLYENLGFVRDKRLFRYYLNGVDALRLKLWLR

SEQ ID NO: 1475 - protein, 747 aa, Homo sapiens
MEVKRLKVTELRSELQRRGLDSRGLKVDLAQRLQEALDAEMLEDEAGGGGAGPGGACKAEPRPVAASGGGPGGDEEEDEEEEEEDEEALLEDEDEEPPPAQALGQAAQPPPEPPEAAAMEAAAEPDASEKPAEATAGSGGVNGGEEQGLGKREEDEPEERSGDETPGSEVPGDKAAEEQGDDQDSEKSKPAGSDGERRGVKRQRDEKDEHGRAYYEFREEAYHSRSKSPLPPEEEAKDEEEDQTLVNLDTYTSDLHFQVSKDRYGGQPLFSEKFPTLWSGARSTYGVTKGKVCFEAKVTQNLPMKEGCTEVSLLRVGWSVDFSRPQLGEDEFSYGFDGRGLKAENGQFEEFGQTFGENDVIGCFANFETEEVELSFSKNGEDLGVAFWISKDSLADRALLPHVLCKNCVVELNFGQKEEPFFPPPEEFVFIHAVPVEERVRTAVPPKTIEECEVILMVGLPGSGKTQWALKYAKENPEKRYNVLGAETVLNQMRMKGLEEPEMDPKSRDLLVQQASQCLSKLVQIASRTKRNFILDQCNVYNSGQRRKLLLFKTFSRKVVVVVPNEEDWKKRLELRKEVEGDDVPESIMLEMKANFSLPEKCDYMDEVTYGELEKEEAQPIVTKYKEEARKLLPPSEKRTNRRNNRNKRNRQNRSRGQGYVGGQRRGYDNRAYGQQYWGQPGNRGGYRNFYDRYRGDYDRFYGRDYEYNRYRDYYRQYNRDWQSYYYHHPQDRDRYYRNYYGYQGYR

SEQ ID NO: 1476 - protein, 107 aa, Homo sapiens
MAAWSPAAAAPLLRGIRGLPLHHRMFATQTEGELRVTQILKEKFPRATAIKVTDISGGCGAMYEIKIESEEFKEKRTVQQHQMVNQALKEEIKEMHGLRIFTSVPKR

SEQ ID NO: 1477 - protein, 374 aa, Homo sapiens
MLSTSRSRFIRNTNESGEEVTTFFDYDYGAPCHKFDVKQIGAQLLPPLYSLVFIFGFVGNMLVVLILINCKKLKCLTDIYLLNLAISDLLFLITLPLWAHSAANEWVFGNAMCKLFTGLYHIGYFGGIFFIILLTIDRYLAIVHAVFALKARTVTFGVVTSVITWLVAVFASVPGIIFTKCQKEDSVYVCGPYFPRGWNNFHTIMRNILGLVLPLLIMVICYSGILKTLLRCRNEKKRHRAVRVIFTIMIVYFLFWTPYNIVILLNTFQEFFGLSNCESTSQLDQATQVTETLGMTHCCINPIIYAFVGEKFRSLFHIALGCRIAPLQKPVCGGPGVRPGKNVKVTTQGLLDGRGKGKSIGRAPEASLQDKEGA

SEQ ID NO: 1478 - protein, 116 aa, Homo sapiens
MSWRGRSTYRPRPRRYVEPPEMIGPMRPEQFSDEVEPATPEEGEPATQRQDPAAAQEGQDEGASAGQGPKPEAHSQEQGHPQTGCECEDGPDGQEMDPPNPEEVKTPEEGEKQSQC

SEQ ID NO: 1479 - protein, 381 aa, Homo sapiens
MPFSNSHNALKLRFPAEDEFPDLSAHNNHMAKVLTPELYAELRAKSTPSGFTLDDVIQTGVDNPGHPYIMTVGCVAGDEESYEVFKDLFDPIIEDRHGGYKPSDEHKTDLNPDNLQGGDDLDPNYVLSSRVRTGRSIRGFCLPPHCSRGERRAIEKLAVEALSSLDGDLAGRYYALKSMTEAEQQQLIDDHFLFDKPVSPLLLASGMARDWPDARGIWHNDNKTFLVWVNEEDHLRVISMQKGGNMKEVFTRFCTGLTQIETLFKSKDYEFMWNPHLGYILTCPSNLGTGLRAGVHIKLPNLGKHEKFSEVLKRLRLQKRGTGGVDTAAVGGVFDVSNADRLGFSEVELVQMVVDGVKLLIEMEQRLEQGQAIDDLMPAQK

SEQ ID NO: 1480 - protein, 232 aa, Homo sapiens
MHRRRSRSCREDQKPVMDDQRDLISNNEQLPMLGRRPGAPESKCSRGALYTGFSILVTLLLAGQATTAYFLYQQQGRLDKLTVTSQNLQLENLRMKLPKPPKPVSKMRMATPLLMQALPMGALPQGPMQNATKYGNMTEDHVMHLLQNADPLKVYPPLKGSFPENLRHLKNTMETIDWKVFESWMHHWLLFEMSRHSLEQKPTDAPPKESLELEDPSSGLGVTKQDLGPVPM

SEQ ID NO: 1481 - protein, 282 aa, Homo sapiens
MPPHHLLPWLAQVPSAEGELVRLVSRAGGRGACFWPAVTMEMAVAAGCVCKGGGCCHREPSQDHHESQEHRGPLVGSQTCLVHQAEGTAEKVSSLGKDWHKFCLKCERCSKTLTPGGHAEHDGKPFCHKPCYATLFGPKGVNIGGAGSYIYEKPLAEGPQVTGPIEVPAARAEERKASGPPKGPSRASSVTTFTGEPNTCPRCSKKVYFAEKVTSLGKDWHRPCLRCERCGKTLTPGGHAEHDGQPYCHKPCYGILFGPKGVNTGAVGSYIYDRDPEGKVQP

SEQ ID NO: 1482 - protein, 288 aa, Homo sapiens [sequence omitted]

SEQ ID NO: 1483 - protein, 2639 aa, Homo sapiens
MSSSHSRAGQSAAGAAPGGGVDTRDAEMPATEKDLAEDAPWKKIQQNTFTRWCNEHLKCVSKRIANLQTDLSDGLRLIALLEVLSQKKMHRKHNQRPTFRQMQLENVSVALEFLDRESIKLVSIDSKAIVDGNLKLILGLIWTLILHYSISMPMWDEEEDEEAKKQTPKQRLLGWIQNKLPQLPITNFSRDWQSGRALGALVDSCAPGLCPDWDSWDASKPVTNAREAMQQADDWLGIPQVITPEEIVDPNVDEHSVMTYLSQFPKAKLKPGAPLRPKLNPKKARAYGPGIEPTGNMVKKRAEFTVETRSAGQGEVLVYVEDPAGHQEEAKVTANNDKNRTFSVWYVPEVTGTHKVTVLFAGQHIAKSPFEVYVDKSQGDASKVTAQGPGLEPSGNIANKTTYFEIFTAGAGTGEVEVVIQDPMGQKGTVEPQLEARGDSTYRCSYQPTMEGVHTVHVTFAGVPIPRSPYTVTVGQACNPSACRAVGRGLQPKGVRVKETADFKVYTKGAGSGELKVTVKGPKGEERVKQKDLGDGVYGFEYYPMVPGTYIVTITWGGQNIGRSPFEVKVGTECGNQKVRAWGPGLEGGVVGKSADFVVEAIGDDVGTLGFSVEGPSQAKIECDDKGDGSCDVRYWPQEAGEYAVHVLCNSEDIRLSPFMADIRDAPQDFHPDRVKARGPGLEKTGVAVNKPAEFTVDAKHGGKAPLRVQVQDNEGCPVEALVKDNGNGTYSCSYVPRKPVKHTAMVSWGGVSIPNSPFRVNVGAGSHPNKVKVYGPGVAKTGLKAHEPTYFTVDCAEAGQGDVSIGIKCAPGVVGPAEADIDFDIIRNDNDTFTVKYTPRGAGSYTIMVLFADQATPTSPIRVKVEPSHDASKVKAEGPGLSRTGVELGKPTHFTVNAKAAGKGKLDVQFSGLTKGDAVRDVDIIDHHDNTYTVKYTPVQQGPVGVNVTYGGDPIPKSPFSVAVSPSLDLSKIKVSGLGEKVDVGKDQEFTVKSKGAGGQGKVASKIVGPSGAAVPCKVEPGLGADNSVVRFLPREEGPYEVEVTYDGVPVPGSPFPLEAVAPTKPSKVKAFGPGLQGGSAGSPARFTIDTKGAGTGGLGLTVEGPCEAQLECLDNGDGTCSVSYVPTEPGDYNINILFADTHIPGSPFKAHVVPCFDASKVKCSGPGLERATAGEVGQFQVDCSSAGSAELTIEICSEAGLPAEVYIQDHGDGTHTITYIPLCPGAYTVTIKYGGQPVPNFPSKLQVEPAVDTSGVQCYGPGIEGQGVFREATTEFSVDARALTQTGGPHVKARVANPSGNLTETYVQDRGDGMYKVEYTPYEEGLHSVDVTYDGSPVPSSPFQVPVTEGCDPSRVRVHGPGIQSGTTNKPNKFTVETRGAGTGGLGLAVEGPSEAKMSCMDNKDGSCSVEYIPYEAGTYSLNVTYGGHQVPGSPFKVPVHDVTDASKVKCSGPGLSPGMVRANLPQSFQVDTSKAGVAPLQVKVQGPKGLVEPVDVVDNADGTQTVNYVPSREGPYSISVLYGDEEVPRSPFKVKVLPTHDASKVKASGPGLNTTGVPASLPVEFTIDAKDAGEGLLAVQITDPEGKPKKTHIQDNHDGTYTVAYVPDVTGRYTILIKYGGDEIPFSPYRVRAVPTGDASKCTVTGAGIGPTIQIGEETVITVDTKAAGKGKVTCTVCTPDGSEVDVDVVENEDGTFDIFYTAPQPGKYVICVRFGGEHVPNSPFQVTALAGDQPSVQPPLRSQQLAPQYTYAQGGQQTWAPERPLVGVNGLDVTSLRPFDLVIPFTIKKGEITGEVRMPSGKVAQPTITDNKDGTVTVRYAPSEAGLHEMDIRYDNMHIPGSPLQFYVDYVNCGHVTAYGPGLTHGVVNKPATFTVNTKDAGEGGLSLAIEGPSKAEISCTDNQDGTCSVSYLPVLPGDYSILVKYNEQHVPGSPFTARVTGDDSMRMSHLKVGSAADIPINISETDLSLLTATVVPPSGREEPCLLKRLRNGHVGISFVPKETGEHLVHVKKNGQHVASSPIPVVISQSEIGDASRVRVSGQGLHEGHTFEPAEFIIDTRDAGYGGLSLSIEGPSKVDINTEDLEDGTCRVTYCPTEPGNYIINIKFADQHVPGSPFSVKVTGEGRVKESITRRRRAPSVANVGSHCDLSLKIPEISIQDMTAQVTSPSGKTHEAEIVEGENHTYCIRFVPAEMGTHTVSVKYKGQHVPGSPFQFTVGPLGEGGAHKVRAGGPGLERAEAGVPAEFSIWTREAGAGGLAIAVEGPSKAEISFEDRKDGSCGVAYVVQEPGDYEVSVKFNEEHIPDSPFVVPVASPSGDARRLTVSSLQESGLKVNQPASFAVSLNGAKGAIDAKVHSPSGALEECYVTEIDQDKYAVRFIPRENGVYLIDVKFNGTHIPGSPFKIRVGEPGHGGDPGLVSAYGAGLEGGVTGNPAEFVVNTSNAGAGALSVTIDGPSKVKMDCQECPEGYRVTYTPMAPGSYLISIKYGGPYHIGGSPFKAKVTGPRLVSNHSLHETSSVFVDSLTKATCAPQHGAPGPGPADASKVVAKGLGLSKAYVGQKSSFTVDCSKAGNNMLLVGVHGPRTPCEEILVKHVGSRLYSVSYLLKDKGEYTLVVKWGDEHIPGSPYRVVVP

SEQ ID NO: 1484 - protein, 572 aa, Homo sapiens
METPSQRRATRSGAQASSTPLSPTRITRLQEKEDLQELNDRLAVYIDRVRSLETENAGLRLRITESEEVVSREVSGIKAAYEAELGDARKTLDSVAKERARLQLELSKVREEFKELKARNTKKEGDLIAAQARLKDLEALLNSKEAALSTALSEKRTLEGELHDLRGQVAKLEAALGEAKKQLQDEMLRRVDAENRLQTMKEELDFQKNIYSEELRETKRRHETRLVEIDNGKQREFESRLADALQELRAQHEDQVEQYKKELEKTYSAKLDNARQSAERNSNLVGAAHEELQQSRIRIDSLSAQLSQLQKQLAAKEAKLRDLEDSLARERDTSRRLLAEKEREMAEMRARMQQQLDEYQELLDIKLALDMEIHAYRKLLEGEEERLRLSPSPTSQRSRGRASSHSSQTQGGGSVTKKRKLESTESRSSFSQHARTSGRVAVEEVDEEGKFVRLRNKSNEDQSMGNWQIKRQNGDDPLLTYRFPPKFTLKAGQVVTIWAAGAGATHSPPTDLVWKAQNTWGCGNSLRTALINSTGEEVAMRKLVRSVTVVEDDEDEDGDDLLHHHHVSGSRR

SEQ ID NO: 1485 - protein, 484 aa, Homo sapiens
MTPGTQSPFFLLLLLTVLTATTAPKPATVVTGSGHASSTPGGEKETSATQRSSVPSSTEKNAVSMTSSVLSSHSPGSGSSTTQGQDVTLAPATEPASGSAATWGQDVTSVPVTRPALGSTTPPAHDVTSAPDNKPAPGSTAPPAHGVTSAPDTRPAPGSTAPPAHGVTSAPDNRPALGSTAPPVHNVTSASGSASGSASTLVHNGTSARATTTPASKSTPFSIPSHHSDTPTTLASHSTKTDASSTHHSTVPPLTSSNHSTSPQLSTGVSFFFLSFHISNLQFNSSLEDPSTDYYQELQRDISEMFLQIYKQGGFLGLSNIKFRPGSVVVQLTLAFREGTINVHDVETQFNQYKTEAASRYNLTISDVSVSDVPFPFSAQSGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAATSANL

SEQ ID NO: 1486 - protein, 417 aa, Homo sapiens
MSLSNKLTLDKLDVKGKRVVMRVDFNVPMKNNQITNNQRIKAAVPSIKFCLDNGAKSVVLMSHLGRPDGVPMPDKYSLEPVAVELKSLLGKDVLFLKDCVGPEVEKACANPAAGSVILLENLRFHVEEEGKGKDASGNKVKAEPAKIEAFRASLSKLGDVYVNDAFGTAHRAHSSMVGVNLPQKAGGFLMKKELNYFAKALESPERPFLAILGGAKVADKIQLINNMLDKVNEMIIGGGMAFTFLKVLNNMEIGTSLFDEEGAKIVKDLMSKAEKNGVKITLPVDFVTADKFDENAKTGQATVASGIPAGWMGLDCGPESSKKYAEAVTRAKQIVWNGPVGVFEWEAFARGTKALMDEVVKATSRGCITIIGGGDTATCCAKWNTEDKVSHVSTGGGASLELLEGKVLPGVDALSNI

SEQ ID NO: 1487 - protein, 810 aa, Homo sapiens
MEHKEVVLLLLLFLKSGQGEPLDDYVNTQGASLFSVTKKQLGAGSIEECAAKCEEDEEFTCRAFQYHSKEQQCVIMAENRKSSIIIRMRDVVLFEKKVYLSECKTGNGKNYRGTMSKTKNGITCQKWSSTSPHRPRFSPATHPSEGLEENYCRNPDNDPQGPWCYTTDPEKRYDYCDILECEEECMHCSGENYDGKISKTMSGLECQAWDSQSPHAHGYIPSKFPNKNLKKNYCRNPDRELRPWCFTTDPNKRWELCDIPRCTTPPPSSGPTYQCLKGTGENYRGNVAVTVSGHTCQHWSAQTPHTHNRTPENFPCKNLDENYCRNPDGKRAPWCHTTNSQVRWEYCKIPSCDSSPVSTEQLAPTAPPELTPVVQDCYHGDGQSYRGTSSTTTTGKKCQSWSSMTPHRHQKTPENYPNAGLTMNYCRNPDADKGPWCFTTDPSVRWEYCNLKKCSGTEASVVAPPPVVLLPDVETPSEEDCMFGNGKGYRGKRATTVTGTPCQDWAAQEPHRHSIFTPETNPRAGLEKNYCRNPDGDVGGPWCYTTNPRKLYDYCDVPQCAAPSFDCGKPQVEPKKCPGRVVGGCVAHPHSWPWQVSLRTRFGMHFCGGTLISPEWVLTAAHCLEKSPRPSSYKVILGAHQEVNLEPHVQEIEVSRLFLEPTRKDIALLKLSSPAVITDKVIPACLPSPNYVVADRTECFITGWGETQGTFGAGLLKEAQLPVIENKVCNRYEFLNGRVQSTELCAGHLAGGTDSCQGDSGGPLVCFEKDKYILQGVTSWGLGCARPNKPGVYVRVSRFVTWIEGVMRNN

SEQ ID NO: 1488 - protein, 971 aa, Homo sapiens
MGGMGTPGDLHAACPSTTRRDALCLGPEFEFDLRHSAGCPGDLGFFPLDPDTEAGGSGCLPTWLPLRRLARGRLEVTADLAERRRIRSAIRELQRQELEREEEALASKRFRAERQDNKENWLHSQQREAEQRAALARLAGQLESMNDVEELTALLRSAGEYEERKLIRAAIRRVRAQEIEAATLAGRLYSGRPNSGSREDSKGLAAHRLEQCEVPEREEQEQQAEVSKPTPTPEGTSQDVTTVTLLLRAPPGSTSSSPASPSSSPTPASPEPPLEPAEAQCLTAEVPGSPEPPPSPPKTTSPEPQESPTLPSTEGQVVNKLLSGPKETPAAQSPTRGPSDTKRADVAGPRPCQRSLSVLSPRQPAQNRESTPLASGPSSFQRAGSVRDRVHKFTSDSPMAARLQDGTPQAALSPLTPARLLGPSLTSTTPASSSSGSSSRGPSDTSSRFSKEQRGVAQPLAQLRSCPQEEGPRGRGLAARPLENRAGGPVARSEEPGAPLPVAVGTAEPGGSMKTTFTIEIKDGRGQASTGRVLLPTGNQRAELTLGLRAPPTLLSTSSGGKSTITRVNSPGTLARLGSVTHVTSFSHAPPSSRGGCSIKMEAEPAEPLAAAVEAANGAEQTRVNKAPEGRSPLSAEELMTIEDEGVLDKMLDQSTDFEERKLIRAALRELRQRKRDQRDKERERRLQEARGRPGEGRGNTATETTTRHSQRAADGSAVSTVTKTERLVHSNDGTRTARTTTVESSFVRRSENGSGSTMMQTKTFSSSSSSKKMGSIFDREDQASPRAGSLAALEKRQAEKKKELMKAQSLPKTSASQARKAMIEKLEKEGAAGSPGGPRAAVQRSTSFGVPNANSIKQMLLDWCRAKTRGYEHVDIQNFSSSWSDGMAFCALVHNFFPEAFDYGQLSPQNRRQNFEVAFSSAETHADCPQLLDTEDMVRLREPDWKCVYTYIQEFYRCLVQKGLVKTKKS

SEQ ID NO: 1489 - protein, 559 aa, Homo sapiens
MPLVKRNIDPRHLCHTALPRGIKNELECVTNISLANIIRQLSSLSKYAEDIFGELFNEAHSFSFRVNSLQERVDRLSVSVTQLDPKEEELSLQDITMRKAFRSSTIQDQQLFDRKTLPIPLQETYDVCEQPPPLNILTPYRDDGKEGLKFYTNPSYFFDLWKEKMLQDTEDKRKEKRKQKQKNLDRPHEPEKVPRAPHDRRREWQKLAQGPELAEDDANLLHKHIEVANGPASHFETRPQTYVDHMDGSYSLSALPFSQMSELLTRAEERVLVRPHEPPPPPPMHGAGDAKPIPTCISSATGLIENRPQSPATGRTPVFVSPTPPPPPPPLPSALSTSSLRASMTSTPPPPVPPPPPPPATALQAPAVPPPPAPLQIAPGVLHPAPPPIAPPLVQPSPPVARAAPVCETVPVHPLPQGEVQGLPPPPPPPPLPPPGIRPSSPVTVTALAHPPSGLHPTPSTAPGPHVPLMPPSPPSQVIPASEPKRHPSTLPVISDARSVLLEAIRKGIQLRKVEEQREQEAKHERIENDVATILSRRIAVEYSDSEDDSEFDEVDWLE

SEQ ID NO: 1490 - protein, 341 aa, Homo sapiens
MTDGILGKAATMEIPIHGNGEARQLPEDDGLEQDLQQVMVSGPNLNETSIVSGGYGGSGDGLIPTGSGRHPSHSTTPSGPGDEVARGIAGEKFDIVKKWGINTYKCTKQLLSERFGRGSRTVDLELELQIELLRETKRKYESVLQLGRALTAHLYSLLQTQHALGDAFADLSQKSPELQEEFGYNAETQKLLCKNGETLLGAVNFFVSSINTLVTKTMEDTLMTVKQYEAARLEYDAYRTDLEELSLGPRDAGTRGRLESAQATFQAHRDKYEKLRGDVAIKLKFLEENKIKVMHKQLLLFHNAVSAYFAGNQKQLEQTLQQFNIKLRPPGAEKPSWLEEQ

SEQ ID NO: 1491 - protein, 2390 aa, Homo sapiens
MSSTLSPTDFDSLEIQGQYSDINNRWDLPDSDWDNDSSSARLFERSRIKALADEREAVQKKTFTKWVNSHLARVTCRVGDLYSDLRDGRNLLRLLEVLSGEILPKPTKGRMRIHCLENVDKALQFLKEQKVHLENMGSHDIVDGNHRLTLGLVWTIILRFQIQDISVETEDNKEKKSAKDALLLWCQMKTAGYPNVNVHNFTTSWRDGLAFNAIVHKHRPDLLDFESLKKCNAHYNLQNAFNLAEKELGLTKLLDPEDVNVDQPDEKSIITYVATYYHYFSKMKALAVEGKRIGKVLDHAMEAERLVEKYESLASELLQWIEQTIVTLNDRQLANSLSGVQNQLQSFNSYRTVEKPPKFTEKGNLEVLLFTIQSKLRANNQKVYTPREGRLISDINKAWERLEKAEHERELALRTELIRQEKLEQLAARFDRKAAMRETWLSENQRLVSQDNFGLELAAVEAAVRKHEAIETDIVAYSGRVQAVDAVAAELAAERYHDIKRIAARQHNVARLWDFLRQMVAARRERLLLNLELQKVFQDLLYLMDWMEEMKGRLQSQDLGRHLAGVEDLLQLHELVEADIAVQAERVRAVSASALRFCNPGKEYRPCDPQLVSERVAKLEQSYEALCELAAARRARLEESRRLWRFLWEVGEAEAWVREQQHLLASADTGRDLTGALRLLNKHTALRGEMSGRLGPLKLTLEQGQQLVAEGHPGASQASARAAELQAQWERLEALAEERAQRLAQAASLYQFQADANDMEAWLVDALRLVSSPELGHDEFSTQALARQHRALEEEIRSHRPTLDALREQAAALPPTLSRTPEVQGRVPTLERHYEELQARAGERARALEAALALYTMLSEAGACGLWVEEKEQWLNGLALPERLEDLEVVQQRFETLEPEMNTLAAQITAVNDIAEQLLKANPPGKDRIVNTQEQLNHRWQQFRRLADGKKAALTSALSIQNYHLECTETQAWMREKTKVIESTQGLGNDLAGVLALQRKLAGTERDLEAIAARVGELTREANALAAGHPAQAVAINARLREVQTGWEDLRATMRRREESLGEARRLQDFLRSLDDFQAWLGRTQTAVASEEGPATLPEAEALLAQHAALRGEVERAQSEYSRLRALGEEVTRDQADPQCLFLRQRLEALGTGWEELGRMWESRQGRLAQAHGFQGFLRDARQAEGVLSSQEYVLSHTEMPGTLQAADAAIKKLEDFMSTMDANGERIHGLLEAGRQLVSEGNIHADKIREKADSIERRHKKNQDAAQQFLGRLRDNREQQHFLQDCHELKLWIDEKMLTAQDVSYDEARNLHTKWQKHQAFMAELAANKDWLDKVDKEGRELTLEKPELKALVSEKLRDLHRRWDELETTTQAKARSLFDANRAELFAQSCCALESWLESLQAQLHSDDYGKDLTSVNILLKKQQMLEWEMAVREKEVEAIQAQAKALAQEDQGAGEVERTSRAVEEKFRALCQPMRERCRRLQASREQHQFHRDVEDEILWVTERLPMASSMEHGKDLPSVQLLMKKNQTLQKEIQGHEPRIADLRERQRALGAAAAGPELAELQEMWKRLGHELELRGKRLEDALRAQQFYRDAAEAEAWMGEQELHMMGQEKAKDELSAQAEVKKHQVLEQALADYAQTIHQLAASSQDMIDHEHPESTRISIRQAQVDKLYAGLKELAGERRERLQEHLRLCQLRRELDDLEQWIQEREVVAASHELGQDYEHVTMLRDKFREFSRDTSTIGQERVDSANALANGLIAGGHAARATVAEWKDSLNEAWADLLELLDTRGQVLAAAYELQRFLHGARQALARVQHKQQQLPDGTGRDLNAAEALQRRHCAYEHDIQALSPQVQQVQDDGHRLQKAYAGDKAEEIGRHMQAVAEAWAQLQGSSAARRQLLLDTTDKFRFFKAVRELMLWMDEVNLQMDAQERPRDVSSADLVIKNQQGIKAEIEARADRFSSCIDMGKELLARSHYAAEEISEKLSQLQARRQETAEKWQEKMDWLQLVLEVLVFGRDAGMAEAWLCSQEPLVRSAELGCTVDEVESLIKRHEAFQKSAVAWEERFCALEKLTALEEREKERKRKREEEERRKQPPAPEPTASVPPGDLVGGQTASDTTWDGTQPRPPPSTQAPSVNGVCTDGEPSQPLLGQQRLEHSSFPEGPGPGSGDEANGPRGERQTRTRGPAPSAMPQSRSTESAHAATLPPRGPEPSAQEQMEGMLCRKQEMEAFGKKAANRSWQNVYCVLRRGSLGFYKDAKAASAGVPYHGEVPVSLARAQGSVAFDYRKRKHVFKLGLQDGKEYLFQAKDEAEMSSWLRVVNAAIATASSASGEPEEPVVPSTTRGMTRAMTMPPVSPVGAEGPVVLRSKDGREREREKRFSFFKKNK

SEQ ID NO: 1492 - protein, 504 aa, Homo sapiens
MVLADLGRKITSALRSLSNATIINEEVLNAMLKEVCTALLEADVNIKLVKQLRENVKSAIDLEEMASGLNKRKMIQHAVFKELVKLVDPGVKAWTPTKGKQNVIMFVGLQGSGKTTTCSKLAYYYQRKGWKTCLICADTFRAGAFDQLKQNATKARIPFYGSYTEMDPVIIASEGVEKFKNENFEIIIVDTSGRHKQEDSLFEEMLQVANAIQPDNIVYVMDASIGQACEAQAKAFKDKVDVASVIVTKLDGHAKGGGALSAVAATKSPIIFIGTGEHIDDFEPFKTQPFISKLLGMGDIEGLIDKVNELKLDDNEALIEKLKHGQFTLRDMYEQFQNIMKMGPFSQILGMIPGFGTDFMSKGNEQESMARLKKLMTIMDSMNDQELDSTDGAKVFSKQPGRIQRVARGSGVSTRDVQELLTQYTKFAQMVKKMGGIKGLFKGGDMSKNVSQSQMAKLNQQMAKMMDPRVLHHMGGMAGLQSMMRQFQQGAAGNMKGMMGFNNM

SEQ ID NO: 1493 - protein, 420 aa, Homo sapiens
MEVPPRLSHVPPPLFPSAPATLASRSLSHWRPRPPRQLAPLLPSLAPSSARQGARRAQRHVTAQQPSRLAGGAAIKGGRRRRPDLFRRHFKSSSIQRSAAAAAATRTARQHPPADSSVTMEDMNEYSNIEEFAEGSKINASKNQQDDGKMFIGGLSWDTSKKDLTEYLSRFGEVVDCTIKTDPVTGRSRGFGFVLFKDAASVDKVLELKEHKLDGKLIDPKRAKALKGKEPPKKVFVGGLSPDTSEEQIKEYFGAFGEIENIELPMDTKTNERRGFCFITYTDEEPVKKLLESRYHQIGSGKCEIKVAQPKEVYRQQQQQQKGGRGAAAGGRGGTRGRGRGQGQNWNQGFNNYYDQGYGNYNSAYGGDQNYSGYGGYDYTGYNYGNYGYGQGYADYSGQQSTYGKASRGGGNHQNNYQPY

SEQ ID NO: 1494 - protein, 396 aa, Homo sapiens
MFLKAVVLTLALVAVAGARAEVSADQVATVMWDYFSQLSNNAKEAVEHLQKSELTQQLNALFQDKLGEVNTYAGDLQKKLVPFATELHERLAKDSEKLKEEIGKELEELRARLLPHANEVSQKIGDNLRELQQRLEPYADQLRTQVSTQAEQLRRQLTPYAQRMERVLRENADSLQASLRPHADELKAKIDQNVEELKGRLTPYADEFKVKIDQTVEELRRSLAPYAQDTQEKLNHQLEGLTFQMKKNAEELKARISASAEELRQRLAPLAEDVRGNLRGNTEGLQKSLAELGGHLDQQVEEFRRRVEPYGENFNKALVQQMEQLRQKLGPHAGDVEGHLSFLEKDLRDKVNSFFSTFKEKESQDKTLSLPELEQQQEQQQEQQQEQVQMLAPLES

SEQ ID NO: 1495 - protein, 478 aa, Homo sapiens
MGRCCFYTAGTLSLLLLVTSVTLLVARVFQKAVDQSIEKKIVLRNGTEAFDSWEKPPLPVYTQFYFFNVTNPEEILRGETPRVEEVGPYTYRELRNKANIQFGDNGTTISAVSNKAYVFERDQSVGDPKIDLIRTLNIPVLTVIEWSQVHFLREIIEAMLKAYQQKLFVTHTVDELLWGYKDEILSLIHVFRPDISPYFGLFYEKNGTNDGDYVFLTGEDSYLNFTKIVEWNGKTSLDWWITDKCNMINGTDGDSFHPLITKDEVLYVFPSDFCRSVYITFSDYESVQGLPAFRYKVPAEILANTSDNAGFCIPEGNCLGSGVLNVSICKNGAPIIMSFPHFYQADERFVSAIEGMHPNQEDHETFVDINPLTGIILKAAKRFQINIYVKKLDDFVETGDIRTMVFPVMYLNESVHIDKETASRLKSMINTTLIITNIPYIIMALGVFFGLVFTWLACKGQGSMDEGTADERAPLIRT

SEQ ID NO: 1496 - protein, 306 aa, Homo sapiens
MASNVTNKTDPRSMNSRVFIGNLNTLVVKKSDVEAIFSKYGKIVGCSVHKGFAFVQYVNERNARAAVAGEDGRMIAGQVLDINLAAEPKVNRGKAGVKRSAAEMYGSVTEHPSPSPLLSSSFDLDYDFQRDYYDRMYSYPARVPPPPPIARAVVPSKRQRVSGNTSRRGKSGFNSKSGQRGSSKSGKLKGDDLQAIKKELTQIKQKVDSLLENLEKIEKEQSKQAVEMKNDKSEEEQSSSSVKKDETNVKMESEGGADDSAEEGDLLDDDDNEDRGDDQLELIKDDEKEAEEGEDDRDSANGEDDS

SEQ ID NO: 1497 - protein, 415 aa, Homo sapiens
MMLGPEGGEGFVVKLRGLPWSCSVEDVQNFLSDCTIHDGAAGVHFIYTREGRQSGEAFVELGSEDDVKMALKKDRESMGHRYIEVFKSHRTEMDWVLKHSGPNSADSANDGFVRLRGLPFGCTKEEIVQFFSGLEIVPNGITLPVDPEGKITGEAFVQFASQELAEKALGKHKERIGHRYIEVFKSSQEEVRSYSDPPLKFMSVQRPGPYDRPGTARRYIGIVKQAGLERMRPGAYSTGYGGYEEYSGLSDGYGFTTDLFGRDLSYCLSGMYDHRYGDSEFTVQSTTGHCVHMRGLPYKATENDIYNFFSPLNPVRVHIEIGPDGRVTGEADVEFATHEEAVAAMSKDRANMQHRYIELFLNSTTGASNGAYSSQVMQGMGVSAAQATYSGLESQSVSGCYGAGYSGQNSMGGYD

SEQ ID NO: 1498 - protein, 679 aa, Homo sapiens
MISASRAAAARLVGAAASRGPTAARHQDSWNGLSHEAFRLVSRRDYASEAIKGAVVGIDLGTTNSCVAVMEGKQAKVLENAEGARTTPSVVAFTADGERLVGMPAKRQAVTNPNNTFYATKRLIGRRYDDPEVQKDIKNVPFKIVRASNGDAWVEAHGKLYSPSQIGAFVLMKMKETAENYLGHTAKNAVITVPAYFNDSQRQATKDAGQISGLNVLRVINEPTAAALAYGLDKSEDKVIAVYDLGGGTFDISILEIQKGVFEVKSTNGDTFLGGEDFDQALLRHIVKEFKRETGVDLTKDNMALQRVREAAEKAKCELSSSVQTDINLPYLTMDSSGPKHLNMKLTRAQFEGIVTDLIRRTIAPCQKAMQDAEVSKSDIGEVILVGGMTRMPKVQQTVQDLFGRAPSKAVNPDEAVAIGAAIQGGVLAGDVTDVLLLDVTPLSLGIETLGGVFTKLINRNTTIPTKKSQVFSTAADGQTQVEIKVCQGEREMAGDNKLLGQFTLIGIPPAPRGVPQIEVTFDIDANGIVHVSAKDKGTGREQQIVIQSSGGLSKDDIENMVKNAEKYAEEDRRKKERVEAVNMAEGIIHDTETKMEEFKDQLPADECNKLKEEISKMRELLARKDSETGENIRQAASSLQQASLKLFEMAYKKMASEREGSGSSGTGEQKEDQKEEKQ

SEQ ID NO: 1499 - protein, 195 aa, Homo sapiens
MALLFPLLAALVMTSYSPVGSLGCDLPQNHGLLSRNTLVLLHQMRRISPFLCLKDRRDFRFPQEMVKGSQLQKAHVMSVLHEMLQQIFSLFHTERSSAAWNMTLLDQLHTGLHQQLQHLETCLLQVVGEGESAGAISSPALTLRRYFQGIRVYLKEKKYSDCAWEVVRMEIMKSLFLSTNMQERLRSKDRDLGSS

SEQ ID NO: 1500 - protein, 963 aa, Homo sapiens
MADLAECNIKVMCRFRPLNESEVNRGDKYIAKFQGEDTVVIASKPYAFDRVFQSSTSQEQVYNDCAKKIVKDVLEGYNGTIFAYGQTSSGKTHTMEGKLHDPEGMGIIPRIVQDIFNYIYSMDENLEFHIKVSYFEIYLDKIRDLLDVSKTNLSVHEDKNRVPYVKGCTERFVCSPDEVMDTIDEGKSNRHVAVTNMNEHSSRSHSIFLINVKQENTQTEQKLSGKLYLVDLAGSEKVSKTGAEGAVLDEAKNINKSLSALGNVISALAEGSTYVPYRDSKMTRILQDSLGGNCRTTIVICCSPSSYNESETKSTLLFGQRAKTIKNTVCVNVELTAEQWKKKYEKEKEKNKILRNTIQWLENELNRWRNGETVPIDEQFDKEKANLEAFTVDKDITLTNDKPATAIGVIGNFTDAERRKCEEEIAKLYKQLDDKDEEINQQSQLVEKLKTQMLDQEELLASTRRDQDNMQAELNRLQAENDASKEEVKEVLQALEELAVNYDQKSQEVEDKTKEYELLSDELNQKSATLASIDAELQKLKEMTNHQKKRAAEMMASLLKDLAEIGIAVGNNDVKQPEGTGMIDEEFTVARLYISKMKSEVKTMVKRCKQLESTQTESNKKMEENEKELAACQLRISQHEAKIKSLTEYLQNVEQKKRQLEESVDALSEELVQLRAQEKVHEMEKEHLNKVQTANEVKQAVEQQIQSHRETHQKQISSLRDEVEAKAKLITDLQDQNQKMMLEQERLRVEHEKLKATDQEKSRKLHELTVMQDRREQARQDLKGLEETVAKELQTLHNLRKLFVQDLATRVKKSAEIDSDDTGGSAAQKQKISFLENNLEQLTKVHKQLVRDNADLRCELPKLEKRLRATAERVKALESALKEAKENASRDRKRYQQEVDRIKEAVRSKNMARRGHSAQIAKPIRPGQHPAASPTHPSAIRGGGAFVQNSQPVAVRGGGGKQV

SEQ ID NO: 1501 - protein, 356 aa, Homo sapiens
MSRPLLITFTPATDPSDLWKDGQQQPQPEKPESTLDGAAARAFYEALIGDESSAPDSQRSQTEPARERKRKKRRIMKAPAAEAVAEGASGRHGQGRSLEAEDKMTHRILRAAQEGDLPELRRLLEPHEAGGAGGNINARDAFWWTPLMCAARAGQGAAVSYLLGRGAAWVGVCELSGRDAAQLAEEAGFPEVARMVRESHGETRSPENRSPTPSLQYCENCDTHFQDSNHRTSTAHLLSLSQGPQPPNLPLGVPISSPGFKLLLRGGWEPGMGLGPRGEGRANPIPTVLKRDQEGLGYRSAPQPRVTHFPAWDTRAVAGRERPPRVATLSWREERRREEKDRAWERDLRTYMNLEF

SEQ ID NO: 1502 - protein, 130 aa, Homo sapiens
MSGRGKQGGKARAKAKSRSSRAGLQFPVGRVHRLLRKGNYAERVGAGAPVYMAAVLEYLTAEILELAGNAARDNKKTRIIPRHLQLAIRNDEELNKLLGKVTIAQGGVLPNIQAVLLPKKTESHHKAKGK

SEQ ID NO: 1503 - protein, 438 aa, Homo sapiens
MAAGLRKRGRSGSAAQAEGLCKQWLQRAWQERRLLLREPRYTLLVAACLCLAEVGITFWVIHRVAYTEIDWKAYMAEVEGVINGTYDYTQLQGDTGPLVYPAGFVYIFMGLYYATSRGTDIRMAQNIFAVLYLATLLLVFLIYHQTCKVPPFVFFFMCCASYRVHSIFVLRLFNDPVAMVLLFLSINLLLAQRWGWGCCFFSLAVSVKMNVLLFAPGLLFLLLTQFGFRGALPKLGICAGLQVVLGLPFLLENPSGYLSRSFDLGRQFLFHWTVNWRFLPEALFLHRAFHLALLTAHLTLLLLFALCRWHRTGESILSLLRDPSKRKVPPQPLTPNQIVSTLFTSNFIGICFSRSLHYQFYVWYFHTLPYLLWAMPARWLTHLLRLLVLGLIELSWNTYPSTSCSSAALHICHAVILLQLWLGPQPFPKSTQHSKKAH

SEQ ID NO: 1504 - protein, 824 aa, Homo sapiens
MSAPSEEEEYARLVMEAQPEWLRAEVKRLSHELAETTREKIQAAEYGLAVLEEKHQLKLQFEELEVDYEAIRSEMEQLKEAFGQAHTNHKKVAADGESREESLIQESASKEQYYVRKVLELQTELKQLRNVLTNTQSENERLASVAQELKEINQNVEIQRGRLRDDIKEYKFREARLLQDYSELEEENISLQKQVSVLRQNQVEFEGLKHEIKRLEEETEYLNSQLEDAIRLKEISERQLEEALETLKTEREQKNSLRKELSHYMSINDSFYTSHLHVSLDGLKFSDDAAEPNNDAEALVNGFEHGGLAKLPLDNKTSTPKKEGLAPPSPSLVSDLLSELNISEIQKLKQQLMQMEREKAGLLATLQDTQKQLEHTRGSLSEQQEKVTRLTENLSALRRLQASKERQTALDNEKDRDSHEDGDYYEVDINGPEILACKYHVAVAEAGELREQLKALRSTHEAREAQHAEEKGRYEAEGQALTEKVSLLEKASRQDRELLARLEKELKKVSDVAGETQGSLSVAQDELVTFSEELANLYHHVCMCNNETPNRVMLDYYREGQGGAGRTSPGGRTSPEARGRRSPILLPKGLLAPEAGRADGGTGDSSPSPGSSLPSPLSDPRREPMNIYNLIAIIRDQIKHLQAAVDRTTELSRQRIASQELGPAVDKDKEALMEEILKLKSLLSTKREQITTLRTVLKANKQTAEVALANLKSKYENEKAMVTETMMKLRNELKALKEDAATFSSLRAMFATRCDEYITQLDEMQRQLAAAEDEKKTLNSLLRMAIQQKLALTQRLELLELDHEQTRRGRAKAAPKTKPATPSL

SEQ ID NO: 1505 - protein, 2479 aa, Homo sapiens
MPPNINWKEIMKVDPDDLPRQEELADNLLISLSKVEVNELKSEKQENVIHLFRITQSLMKMKAQEVELALEEVEKAGEEQAKFENQLKTKVMKLENELEMAQQSAGGRDTRFLRNEICQLEKQLEQKDRELEDMEKELEKEKKVNEQLALRNEEAENENSKLRRENKRLKKKNEQLCQDIIDYQKQIDSQKETLLSRRGEDSDYRSQLSKKNYELIQYLDEIQTLTEANEKIEVQNQEMRKNLEESVQEMEKMTDEYNRMKAIVHQTDNVIDQLKKENDHYQLQVQELTDLLKSKNEEDDPIMVAVNAKVEEWKLILSSKDDEIIEYQQMLHNLREKLKNAQLDADKSNVMALQQGIQERDSQIKMLTEQVEQYTKEMEKNTCIIEDLKNELQRNKGASTLSQQTHMKIQSTLDILKEKTKEAERTAELAEADAREKDKELVEALKRLKDYESGVYGLEDAVVEIKNCKNQIKIRDREIEILTKEINKLELKISDFLDENEALRERVGLEPKTMIDLTEFRNSKHLKQQQYRAENQILLKEIESLEEERLDLKKKIRQMAQERGKRSATSGLTTEDLNLTENISQGDRISERKLDLLSLKNMSEAQSKNEFLSRELIEKERDLERSRTVIAKFQNKLKELVEENKQLEEGMKEILQAIKEMQKDPDVKGGETSLIIPSLERLVNAIESKNAEGIFDASLHLKAQVDQLTGRNEELRQELRESRKEAINYSQQLAKANLKIDHLEKETSLLRQSEGSNVVFKGIDLPDGIAPSSASIINSQNEYLIHLLQELENKEKKLKNLEDSLEDYNRKFAVIRHQQSLLYKEYLSEKETWKTESKTIKEEKRKLEDQVQQDAIKVKEYNNLLNALQMDSDEMKKILAENSRKITVLQVNEKSLIRQYTTLVELERQLRKENEKQKNELLSMEAEVCEKIGCLQRFKEMAIFKIAALQKVVDNSVSLSELELANKQYNELTAKYRDILQKDNMLVQRTSNLEHLECENISLKEQVESINKELEITKEKLHTIEQAWEQETKLGNESSMDKAKKSITNSDIVSISKKITMLEMKELNERQRAEHCQKMYEHLRTSLKQMEERNFELETKFAELTKINLDAQKVEQMLRDELADSVSKAVSDADRQRILELEKNEMELKVEVSKLREISDIARRQVEILNAQQQSRDKEVESLRMQLLDYQAQSDEKSLIAKLHQHNVSLQLSEATALGKLESITSKLQKMEAYNLRLEQKLDEKEQALYYARLEGRNRAKHLRQTIQSLRRQFSGALPLAQQEKFSKTMIQLQNDKLKIMQEMKNSQQEHRNMENKTLEMELKLKGLEELISTLKDTKGAQKVINWHMKIEELRLQELKLNRELVKDKEEIKYLNNIISEYERTISSLEEEIVQQNKFHEERQMAWDQREVDLERQLDIFDRQQNEILNAAQKFEEATGSIPDPSLPLPNQLEIALRKIKENIRIILETRATCKSLEEKLKEKESALRLAEQNILSRDKVINELRLRLPATAEREKLIAELGRKEMEPKSHHTLKIAHQTIANMQARLNQKEEVLKKYQRLLEKAREEQREIVKKHEEDLHILHHRLELQADSSLNKFKQTAWDLMKQSPTPVPTNKHFIRLAEMEQTVAEQDDSLSSLLVKLKKVSQDLERQREITELKVKEFENIKLQLQENHEDEVKKVKAEVEDLKYLLDQSQKESQCLKSELQAQKEANSRAPTTTMRNLVERLKSQLALKEKQQKALSRALLELRAEMTAAAEERIISATSQKEAHLNVQQIVDRHTRELKTQVEDLNENLLKLKEALKTSKNRENSLTDNLNDLNNELQKKQKAYNKILREKEEIDQENDELKRQIKRLTSGLQGKPLTDNKQSLIEELQRKVKKLENQLEGKVEEVDLKPMKEKNAKEELIRWEEGKKWQAKIEGIRNKLKEKEGEVFTLTKQLNTLKDLFAKADKEKLTLQRKLKTTGMTVDQVLGIRALESEKELEELKKRNLDLENDILYMRAHQALPRDSVVEDLHLQNRYLQEKLHALEKQFSKDTYSKPSISGIESDDHCQREQELQKENLKLSSENIELKFQLEQANKDLPRLKNQVRDLKEMCEFLKKEKAEVQRKLGHVRGSGRSGKTIPELEKTIGLMKKVVEKVQRENEQLKKASGILTSEKMANIEQENEKLKAELEKLKAHLGHQLSMHYESKTKGTEKIIAENERLRKELKKETDAAEKLRIAKNNLEILNEKMTVQLEETGKRLQFAESRGPQLEGADSKSWKSIVVTRMYETKLKELETDIAKKNQSITDLKQLVKEATEREQKVNKYNEDLEQQIKILKHVPEGAETEQGLKRELQVLRLANHQLDKEKAELIHQIEANKDQSGAESTIPDADQLKEKIKDLETQLKMSDLEKQHLKEEIKKLKKELENFDPSFFEEIEDLKYNYKEEVKKNILLEEKVKKLSEQLGVELTSPVAASEEFEDEEESPVNFPIY

SEQ ID NO: 1506 - protein, 190 aa, Homo sapiens
MFQVPDSEGGRAGSRAMKPPGGESSNLFGSPEEATPSSRPNRMASNIFGPTEEPQNIPKRTNPPGGKGSGIFDESTPVQTRQHLNPPGGKTSDIFGSPVTATSRLAHPNKPKDHVFLCEGEEPKSDLKAARSIPAGAEPGEKGSARKAGPAKEQEPMPTVDSHEPRLGPRPRSHNKVLNPPGGKSSISFY

SEQ ID NO: 1507 - protein, 376 aa, Homo sapiens
MGGGGSALRVCADHRGGINWLSLSPDGQRLLTGSEDGTARLWSTADGQCCALLQGHESYVTFCQLEDEAAFTCSADCTIRRWDVLTGQCLQVYRGHTSIVNRILVANNQLFSSSYDRTARVWSVDKGQMSREFRGHRNCVLTLAYSAPWDLPSTPCAEEAAAGGLLVTGSTDGTAKVWQVASGCCHQTLRGHTGAVLCLVLDTPGHTAFTGSTDATIRAWDILSGEQLRVFREHRGSVICLELVNRLVYSGSADRTVKCWLADTGECVRTFTAHRRNVSALKYHAGTLFTGSGDACARAFDAQSGELRRVFRGHTFIINCIQVHGQVLYTASHDGALRLWDVRGLRGAPRPPPPMRSLSRLFSNKVGCAAAPLQPA

SEQ ID NO: 1508 - protein, 360 aa, Homo sapiens
MCKAGFAGDDAPRAVFPSIVGRPRHQGVMVGMGQKDSYVGDEAQSKRGILTLKYPIEHGIVTNWDDMEKIWHHTFYNELRVAPEEHPVLLTEAPLNPKANLEKMTQIMFETFNTPAMYVAIQAVLSLYASGRTTGIVMDSGDGVTHTVPIYEGYALPHAILRLDLAGRDLTDYLMKILTERGYSFTTTAEREIVRDIKEKLCYVALDFEQEMATAASSSSLEKSYELPDGQVITIGNERFRCPEALFQPSFLGMESCGIHETTFNSIMKCDVDIRKDLYANTVLSGGTTMYPGIADRMQKEITALAPSTMKIKIIAPPERKYSVWIGGSILASLSTFQQMWISKQEYDESGPSIVHRKCF

SEQ ID NO: 1509 - protein, 553 aa, Homo sapiens
MLSVRVAAAVVRALPRRAGLVSRNALGSSFIAARNFHASNTHLQKTGTAEMSSILEERILGADTSVDLEETGRVLSIGDGIARVHGLRNVQAEEMVEFSSGLKGMSLNLEPDNVGVVVFGNDKLIKEGDIVKRTGAIVDVPVGEELLGRVVDALGNAIDGKGPIGSKTRRRVGLKAPGIIPRISVREPMQTGIKAVDSLVPIGRGQRELIIGDRQTGKTSIAIDTIINQKRFNDGSDEKKKLYCIYVAIGQKRSTVAQLVKRLTDADAMKYTIVVSATASDAAPLQYLAPYSGCSMGEYFRDNGKHALIIYDDLSKQAVAYRQMSLLLRRPPGREAYPGDVFYLHSRLLERAAKMNDAFGGGSLTALPVIETQAGDVSAYIPTNVISITDGQIFLETELFYKGIRPAINVGLSVSRVGSAAQTRAMKQVAGTMKLELAQYREVAAFAQFGSDLDAATQQLLSRGVRLTELLKQGQYSPMAIEEQVAVIYAGVRGYLDKLEPSKITKFENAFLSHVVSQHQALLGTIRADGKISEQSDAKLKEIVTNFLAGFEA

SEQ ID NO: 1510 - protein, 529 aa, Homo sapiens
MLGFVGRVAAAPASGALRRLTPSASLPPAQLLLRAAPTAVHPVRDYAAQTSPSPKAGAATGRIVAVIGAVVDVQFDEGLPPILNALEVQGRETRLVLEVAQHLGESTVRTIAMDGTEGLVRGQKVLDSGAPIKIPVGPETLGRIMNVIGEPIDERGPIKTKQFAPIHAEAPEFMEMSVEQEILVTGIKVVDLLAPYAKGGKIGLFGGAGVGKTVLIMELINNVAKAHGGYSVFAGVGERTREGNDLYHEMIESGVINLKDATSKVALVYGQMNEPPGARARVALTGLTVAEYFRDQEGQDVLLFIDNIFRFTQAGSEVSALLGRIPSAVGYQPTLATDMGTMQERITTTKKGSITSVQAIYVPADDLTDPAPATTFAHLDATTVLSRAIAELGIYPAVDPLDSTSRIMDPNIVGSEHYDVARGVQKILQDYKSLQDIIAILGMDELSEEDKLTVSRARKIQRFLSQPFQVAEVFTGHMGKLVPLKETIKGFQQILAGEYDHLPEQAFYMVGPIEEAVAKADKLAEEHSS

SEQ ID NO: 1511 - protein, 298 aa, Homo sapiens
MVRMVPVLLSLLLLLGPAVPQENQDGRYSLTYIYTGLSKHVEDVPAFQALGSLNDLQFFRYNSKDRKSQPMGLWRQVEGMEDWKQDSQLQKAREDIFMETLKDIVEYYNDSNGSHVLQGRFGCEIENNRSSGAFWKYYYDGKDYIEFNKEIPAWVPFDPAAQITKQKWEAEPVYVQRAKAYLEEECPATLRKYLKYSKNILDRQDPPSVVVTSHQAPGEKKKLKCLAYDFYPGKIDVHWTRAGEVQEPELRGDVLHNGNGTYQSWVVVAVPPQDTAPYSCHVQHSSLAQPLVVPWEAS

SEQ ID NO: 1512 - protein, 454 aa, Homo sapiens
MPRCPAGAMDEGPVDLRTRPKAAGLPGAALPLRKRPLRAPSPEPAAPRGAAGLVVPLDPLRGGCDLPAVPGPPHGLARPEALYYPGALLPLYPTRAMGSPFPLVNLPTPLYPMMCPMEHPLSADIAMATRADEDGDTPLHIAVVQGNLPAVHRLVNLFQQGGRELDIYNNLRQTPLHLAVITTLPSVVRLLVTAGASPMALDRHGQTAAHLACEHRSPTCLRALLDSAAPGTLDLEARNYDGLTALHVAVNTECQETVQLLLERGADIDAVDIKSGRSPLIHAVENNSLSMVQLLLQHGANVNAQMYSGSSALHSASGRGLLPLVRTLVRSGADSSLKNCHNDTPLMVARSRRVIDILRGKATRPASTSQPDPSPDRSANTSPESSSRLSSNGLLSASPSSSPSQSPPRDPPGFPMAPPNFFLPSPSPPAFLPFAGVLRGPGRPVPPSPAPGGS

SEQ ID NO: 1513 - protein, 1263 aa, Homo sapiens
MEPPGGSLGPGRGTRDKKKGRSPDELPSAGGDGGKSKKFLERFTSMRIKKEKEKPNSAHRNSSASYGDDPTAQSLQDVSDEQVLVLFEQMLLDMNLNEEKQQPLREKDIIIKREMVSQYLYTSKAGMSQKESSKSAMMYIQELRSGLRDMPLLSCLESLRVSLNNNPVSWVQTFGAEGLASLLDILKRLHDEKEETAGSYDSRNKHEIIRCLKAFMNNKFGIKTMLETEEGILLLVRAMDPAVPNMMIDAAKLLSALCILPQPEDMNERVLEAMTERAEMDEVERFQPLLDGLKSGTTIALKVGCLQLINALITPAEELDFRVHIRSELMRLGLHQVLQDLREIENEDMRVQLNVFDEQGEEDSYDLKGRLDDIRMEMDDFNEVFQILLNTVKDSKAEPHFLSILQHLLLVRNDYEARPQYYKLIEECISQIVLHKNGADPDFKCRHLQIEIEGLIDQMIDKTKVEKSEAKAAELEKKLDSELTARHELQVEMKKMESDFEQKLQDLQGEKDALHSEKQQIATEKQDLEAEVSQLTGEVAKLTKELEDAKKEMASLSAAAITVPPSVPSRAPVPPAPPLPGDSGTIIPPPPAPGDSTTPPPPPPPPPPPPPLPGGVCISSPPSLPGGTAISPPPPLSGDATIPPPPPLPEGVGIPSPSSLPGGTAIPPPPPLPGSARIPPPPPPLPGSAGIPPPPPPLPGEAGMPPPPPPLPGGPGIPPPPPFPGGPGIPPPPPGMGMPPPPPFGFGVPAAPVLPFGLTPKKLYKPEVQLRRPNWSKLVAEDLSQDCFWTKVKEDRFENNELFAKLTLTFSAQTKTSKAKKDQEGGEEKKSVQKKKVKELKVLDSKTAQNLSIFLGSFRMPYQEIKNVILEVNEAVLTESMIQNLIKQMPEPEQLKMLSELKDEYDDLAESEQFGVVMGTVPRLRPRLNAILFKLQFSEQVENIKPEIVSVTAACEELRKSESFSNLLEITLLVGNYMNAGSRNAGAFGFNISFLCKLRDTKSTDQKMTLLHFLAELCENDYPDVLKFPDELAHVEKASRVSAENLQKNLDQMKKQISDVERDVQNFPAATDEKDKFVEKMTSFVKDAQEQYNKLRMMHSNMETLYKELGEYFLFDPKKLSVEEFFMDLHNFRNMFLQAVKENQKRRETEEKMRRAKLAKEKAEKERLEKQQKREQLIDMNAEGDETGVMDSLLEALQSGAAFRRKRGPRQANRKAGCAVTSLLASELTKDDAMAAVPAKVSKNSETFPTILEEAKELVGRAS

SEQ ID NO: 1514 - protein, 437 aa, Homo sapiens
MAAGTLYTYPENWRAFKALIAAQYSGAQVRVLSAPPHFHFGQTNRTPEFLRKFPAGKVPAFEGDDGFCVFESNAIAYYVSNEELRGSTPEAAAQVVQWVSFADSDIVPPASTWVFPTLGIMHHNKQATENAKEEVRRILGLLDAYLKTRTFLVGERVTLADITVVCTLLWLYKQVLEPSFRQAFPNTNRWFLTCINQPQFRAVLGEVKLCEKMAQFDAKKFAETQPKKDTPRKEKGSREEKQKPQAERKEEKKAAAPAPEEEMDECEQALAAEPKAKDPFAHLPKSTFVLDEFKRKYSNEDTLSVALPYFWEHFDKDGWSLWYSEYRFPEELTQTFMSCNLITGMFQRLDKLRKNAFASVILFGTNNSSSISGVWVFRGQELAFPLSPDWQVDYESYTWRKLDPGSEETQTLVREYFSWEGAFQHVGKAFNQGKIFK

SEQ ID NO: 1515 - protein, 406 aa, Homo sapiens
MSASQDSRSRDNGPDGMEPEGVIESNWNEIVDSFDDMNLSESLLRGIYAYGFEKPSAIQQRAILPCIKGYDVIAQAQSGTGKTATFAISILQQIELDLKATQALVLAPTRELAQQIQKVVMALGDYMGASCHACIGGTNVRAEVQKLQMEAPHIIVGTPGRVFDMLNRRYLSPKYIKMFVLDEADEMLSRGFKDQIYDIFQKLNSNTQVVLLSATMPSDVLEVTKKFMRDPIRILVKKEELTLEGIRQFYINVEREEWKLDTLCDLYETLTITQAVIFINTRRKVDWLTEKMHARDFTVSAMHGDMDQKERDVIMREFRSGSSRVLITTDLLARGIDVQQVSLVINYDLPTNRENYIHRIGRGGRFGRKGVAINMVTEEDKRTLRDIETFYNTSIEEMPLNVADLI

SEQ ID NO: 1516 - protein, 108 aa, Homo sapiens
MGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLE

SEQ ID NO: 1517 - protein, 183 aa, Homo sapiens [sequence omitted]

SEQ ID NO: 1518 - protein, 335 aa, Homo sapiens
MGKVKVGVNGFGRIGRLVTRAAFNSGKVDIVAINDPFIDLNYMVYMFQYDSTHGKFHGTVKAENGKLVINGNPITIFQERDPSKIKWGDAGAEYVVESTGVFTTMEKAGAHLQGGAKRVIISAPSADAPMFVMGVNHEKYDNSLKIISNASCTTNCLAPLAKVIHDNFGIVEGLMTTVHAITATQKTVDGPSGKLWRDGRGALQNIIPASTGAAKAVGKVIPELNGKLTGMAFRVPTANVSVVDLTCRLEKPAKYDDIKKVVKQASEGPLKGILGYTEHQVVSSDFNSDTHSSTFDAGAGIALNDHFVKLISWYDNEFGYSNRVVDLMAHMASKE

SEQ ID NO: 1519 - protein, 349 aa, Homo sapiens
MASKKVCIVGSGNWGSAIAKIVGGNAAQLAQFDPRVTMWVFEEDIGGKKLTEIINTQHENVKYLPGHKLPPNVVAVPDVVQAAEDADILIFVVPHQFIGKICDQLKGHLKANATGISLIKGVDEGPNGLKLISEVIGERLGIPMSVLMGANIASEVADEKFCETTIGCKDPAQGQLLKELMQTPNFRITVVQEVDTVEICGALKNVVAVGAGFCDGLGFGDNTKAAVIRLGLMEMIAFAKLFCSGPVSSATFLESCGVADLITTCYGGRNRKVAEAFARTGKSIEQLEKELLNGQKLQGPETARELYSILQHKGLVDKFPLFMAVYKVCYEGQPVGEFIHCLQNHPEHM

SEQ ID NO: 1520 - protein, 736 aa, Homo sapiens
MGSPLRFDGRVVLVTGAGAGLGRAYALAFAERGALVVVNDLGGDFKGVGKGSLAADKVVEEIRRRGGKAVANYDSVEEGEKVVKTALDAFGRIDVVVNNAGILRDRSFARISDEDWDIIHRVHLRGSFQVTRAAWEHMKKQKYGRIIMTSSASGIYGNFGQANYSAAKLGLLGLANSLAIEGRKSNIHCNTIAPNAGSRMTQTVMPEDLVEALKPEYVAPLVLWLCHESCEENGGLFEVGAGWIGKLRWERTLGAIVRQKNHPMTPEAVKANWKKICDFENASKPQSIQESTGSIIEVLSKIDSEGGVSANHTSRATSTATSGFAGAIGQKLPPFSYAYTELEAIMYALGVGASIKDPKDLKFIYEGSSDFSCLPTFGVIIGQKSMMGGGLAEIPGLSINFAKVLHGEQYLELYKPLPRAGKLKCEAVVADVLDKGSGVVIIMDVYSYSEKELICHNQFSLFLVGSGGFGGKRTSDKVKVAVAIPNRPPDAVLTDTTSLNQAALYRLSGDWNPLHIDPNFASLAGFDKPILHGLCTFGFSARRVLQQFADNDVSRFKAIKARFAKPVYPGQTLQTEMWKEGNRIHFQTKVQETGDIVISNAYVDLAPTSGTSAKTPSEGGKLQSTFVFEEIGRRLKDIGPEVVKKVNAVFEWHITKGGNIGAKWTIDLKSGSGKVYQGPAKGAADTTIILSDEDFMEVVLGKLDPQKAFFSGRLKARGNIMLSQKLQMILKDYAKL

SEQ ID NO: 1521 - protein, 641 aa, Homo sapiens
MATAKGIAIGIDLGTTYSCVGVFQHGKVEIIANDQGNRTTPSYVAFTDTERLIGDAAKNQVAMNPQNTVFDAKRLIGRKFNDPVVQADMKLWPFQVINEGGKPKVLVSYKGENKAFYPEEISSMVLTKLKETAEAFLGHPVTNAVITVPAYFNDSQRQATKDAGVIAGLNVLRIINEPTAAAIAYGLDKGGQGERHVLIFDLGGGTFDVSILTIDDGIFEVKATAGDTHLGGEDFDNRLVSHFVEEFKRKHKKDISQNKRAVRRLRTACERAKRTLSSSTQANLEIDSLYEGIDFYTSITRARFEELCADLFRGTLEPVEKALRDAKMDKAKIHDIVLVGGSTRIPKVQRLLQDYFNGRDLNKSINPDEAVAYGAAVQAAILMGDKSEKVQDLLLLDVAPLSLGLETAGGVMTALMKRNSTIPTKQTQIFTTYSDNQPGVLIQVYEGERAMTKDNNLLGRFDLTGIPPAPRGVPQIEVTFDIDANGILNVTAMDKSTGKVNKITIANDKGRLSKEEIERMVLDAEKYKAEDEVQREKIAAKNALESYAFNMKSVVSDEGLKGKISESDKNKILDKCNELLSWLEVNQLAEKDEFDHKRKELEQMCNPIITKLYQGGCTGPACGTGYVPGRPATGPTIEEVD

SEQ ID NO: 1522 - protein, 646 aa, Homo sapiens
MSKGPAVGIDLGTTYSCVGVFQHGKVEIIANDQGNRTTPSYVAFTDTERLIGDAAKNQVAMNPTNTVFDAKRLIGRRFDDAVVQSDMKHWPFMVVNDAGRPKVQVEYKGETKSFYPEEVSSMVLTKMKEIAEAYLGKTVTNAVVTVPAYFNDSQRQATKDAGTIAGLNVLRIINEPTAAAIAYGLDKKVGAERNVLIFDLGGGTFDVSILTIEDGIFEVKSTAGDTHLGGEDFDNRMVNHFIAEFKRKHKKDISENKRAVRRLRTACERAKRTLSSSTQASIEIDSLYEGIDFYTSITRARFEELNADLFRGTLDPVEKALRDAKLDKSQIHDIVLVGGSTRIPKIQKLLQDFFNGKELNKSINPDEAVAYGAAVQAAILSGDKSENVQDLLLLDVTPLSLGIETAGGVMTVLIKRNTTIPTKQTQTFTTYSDNQPGVLIQVYEGERAMTKDNNLLGKFELTGIPPAPRGVPQIEVTFDIDANGILNVSAVDKSTGKENKITITNDKGRLSKEDIERMVQEAEKYKAEDEKQRDKVSSKNSLESYAFNMKATVEDEKLQGKINDEDKQKILDKCNEIINWLDKNQTAEKEEFEHQQKELEKVCNPIITKLYQSAGGMPGGMPGGFPGGGAPPSGGASSGPTIEEVD

SEQ ID NO: 1523 - protein, 734 aa, Homo sapiens
MSGFDDPGIFYSDSFGGDAQADEGQARKSQLQRRFKEFLRQYRVGTDRTGFTFKYRDELKRHYNLGEYWIEVEMEDLASFDEDLADYLYKQPAEHLQLLEEAAKEVADEVTRPRPSGEEVLQDIQVMLKSDASPSSIRSLKSDMMSHLVKIPGIIIAASAVRAKATRISIQCRSCRNTLTNIAMRPGLEGYALPRKCNTDQAGRPKCPLDPYFIMPDKCKCVDFQTLKLQELPDAVPHGEMPRHMQLYCDRYLCDKVVPGNRVTIMGIYSIKKFGLTTSRGRDRVGVGIRSSYIRVLGIQVDTDGSGRSFAGAVSPQEEEEFRRLAALPNVYEVISKSIAPSIFGGTDMKKAIACLLFGGSRKRLPDGLTRRGDINLLMLGDPGTAKSQLLKFVEKCSPIGVYTSGKGSSAAGLTASVMRDPSSRNFIMEGGAMVLADGGVVCIDEFDKMREDDRVAIHEAMEQQTISIAKAGITTTLNSRCSVLAAANSVFGRWDETKGEDNIDFMPTILSRFDMIFIVKDEHNEERDVMLAKHVITLHVSALTQTQAVEGEIDLAKLKKFIAYCRVKCGPRLSAEAAEKLKNRYIIMRSGARQHERDSDRRSSIPITVRQLEAIVRIAEALSKMKLQPFATEADVEEALRLFQVSTLDAALSGTLSGVEGFTSQEDQEMLSRIEKQLKRRFAIGSQVSEHSIIKDFTKQKYPEHAIHKVLQLMLRRGEIQHRMQRKVLYRLK

SEQ ID NO: 1524 - protein, 626 aa, Homo sapiens
MDEQEALNSIMNDLVALQMNRRHRMPGYETMKNKDTGHSNRQSDVRIKFEHNGERRIIAFSRPVKYEDVEHKVTTVFGQPLDLHYMNNELSILLKNQDDLDKAIDILDRSSSMKSLRILLLSQDRNHNSSSPHSGVSRQVRIKASQSAGDINTIYQPPEPRSRHLSVSSQNPGRSSPPPGYVPERQQHIARQGSYTSINSEGEFIPETSEQCMLDPLSSAENSLSGSCQSLDRSADSPSFRKSRMSRAQSFPDNRQEYSDRETQLYDKGVKGGTYPRRYHVSVHHKDYSDGRRTFPRIRRHQGNLFTLVPSSRSLSTNGENMGLAVQYLDPRGRLRSADSENALSVQERNVPTKSPSAPINWRRGKLLGQGAFGRVYLCYDVDTGRELASKQVQFDPDSPETSKEVSALECEIQLLKNLQHERIVQYYGCLRDRAEKTLTIFMEYMPGGSVKDQLKAYGALTESVTRKYTRQILEGMSYLHSNMIVHRDIKGANILRDSAGNVKLGDFGASKRLQTICMSGTGMRSVTGTPYWMSPEVISGEGYGRKADVWSLGCTVVEMLTEKPPWAEYEAMAAIFKIATQPTNPQLPSHISEHGRDFLRRIFVEARQRPSAEELLTHHFAQLMY

SEQ ID NO: 1525 - protein, 964 aa, Homo sapiens
MDEQSVESIAEVFRCFICMEKLRDARLCPHCSKLCCFSCIRRWLTEQRAQCPHCRAPLQLRELVNCRWAEEVTQQLDTLQLCSLTKHEENEKDKCENHHEKLSVFCWTCKKCICHQCALWGGMHGGHTFKPLAEIYEQHVTKVNEEVAKLRRRLMELISLVQEVERNVEAVRNAKDERVREIRNAVEMMIARLDTQLKNKLITLMGQKTSLTQETELLESLLQEVEHQLRSCSKSELISKSSEILMMFQQVHRKPMASFVTTPVPPDFTSELVPSYDSATFVLENFSTLRQRADPVYSPPLQVSGLCWRLKVYPDGNGVVRGYYLSVFLELSAGLPETSKYEYRVEMVHQSCNDPTKNIIREFASDFEVGECWGYNRFFRLDLLANEGYLNPQNDTVILRFQVRSPTFFQKSRDQHWYITQLEAAQTSYIQQINNLKERLTIELSRTQKSRDLSPPDNHLSPQNDDALETRAKKSACSDMLLEGGPTTASVREAKEDEEDEEKIQNEDYHHELSDGDLDLDLVYEDEVNQLDGSSSSASSTATSNTEENDIDEETMSGENDVEYNNMELEEGELMEDAAAAGPAGSSHGYVGSSSRISRRTHLCSAATSSLLDIDPLILIHLLDLKDRSSIENLWGLQPRPPASLLQPTASYSRKDKDQRKQQAMWRVPSDLKMLKRLKTQMAEVRCMKTDVKNTLSEIKSSSAASGDMQTSLFSADQAALAACGTENSGRLQDLGMELLAKSSVANCYIRNSTNKKSNSPKPARSSVAGSLSLRRAVDPGENSRSKGDCQTLSEGSPGSSQSGSRHSSPRALIHGSIGDILPKTEDRQCKALDSDAVVVAVFSGLPAVEKRRKMVTLGANAKGGHLEGLQMTDLENNSETGELQPVLPEGASAAPEEGMSSDSDIECDTENEEQEEHTSVGGFHDSFMVMTQPPDEDTHSSFPDGEQIGPEDLSFNTDENSGR

SEQ ID NO: 1526 - protein, 710 aa, Homo sapiens
MVKLAKAGKNQGDPKKMAPPPKEVEEDSEDEEMSEDEEDDSSGEEVVIPQKKGKKAAATSAKKVVVSPTKKVAVATPAKKAAVTPGKKAAATPAKKTVTPAKAVTTPGKKGATPGKALVATPGKKGAAIPAKGAKNGKNAKKEDSDEEEDDDSEEDEEDDEDEDEDEDEIEPAAMKAAAAAPASEDEDDEDDEDDEDDDDDEEDDSEEEAMETTPAKGKKAAKVVPVKAKNVAEDEDEEEDDEDEDDDDDEDDEDDDDEDDEEEEEEEEEEPVKEAPGKRKKEMAKQKAAPEAKKQKVEGTEPTTAFNLFVGNLNFNKSAPELKTGISDVFAKNDLAVVDVRIGMTRKFGYVDFESAEDLEKALELTGLKVFGNEIKLEKPKGKDSKKERDARTLLAKNLPYKVTQDELKEVFEDAAEIRLVSKDGKSKGIAYIEFKTEADAEKTFEEKQGTEIDGRSISLYYTGEKGQNQDYRGGKNSTWSGESKTLVLSNLSYSATEETLQEVFEKATFIKVPQNQNGKSKGYAFIEFASFEDAKEALNSCNKREIEGRAIRLELQGPRGSPNARSQPSKTLFVKGLSEDTTEETLKESFDGSVRARIVTDRETGSSKGFGFVDFNSEEDAKAAKEAMEDGEIDGNKVTLDWAKPKGEGGFGGRGGGRGGFGGRGGGRGGRGGFGGRGRGGFGGRGGFRGGRGGGGDHKPQGKKTKFE

SEQ ID NO: 1527 - protein, 1151 aa, Homo sapiens
MLRRVTVAAVCATRRKLCEAGRELAALWGIETRGRCEDSAAARPFPILAMPGRNKAKSTCSCPDLQPNGQDLGENSRVARLGADESEEEGRRGSLSNAGDPEIVKSPSDPKQYRYIKLQNGLQALLISDLSNMEGKTGNTTDDEEEEEVEEEEEDDDEDSGAEIEDDDEEGFDDEDEFDDEHDDDLDTEDNELEELEERAEARKKTTEKQSAAALCVGVGSFADPDDLPGLAHFLEHMVFMGSLKYPDENGFDAFLKKHGGSDNASTDCERTVFQFDVQRKYFKEALDRWAQFFIHPLMIRDAIDREVEAVDSEYQLARPSDANRKEMLFGSLARPGHPMGKFFWGNAETLKHEPRKNNIDTHARLREFWMRYYSSHYMTLVVQSKETLDTLEKWVTEIFSQIPNNGLPRPNFGHLTDPFDTPAFNKLYRVVPIRKIHALTITWALPPQQQHYRVKPLHYISWLVGHEGKGSILSFLRKKCWALALFGGNGETGFEQNSTYSVFSISITLTDEGYEHFYEVAYTVFQYLKMLQKLGPEKRIFEEIRKIEDNEFHYQEQTDPVEYVENMCENMQLYPLQDILTGDQLLFEYKPEVIGEALNQLVPQKANLVLLSGANEGKCDLKEKWFGTQYSIEDIENSWAELWNSNFELNPDLHLPAENKYIATDFTLKAFDCPETEYPVKIVNTPQGCLWYKKDNKFKIPKAYIRFHLISPLIQKSAANVVLFDIFVNILTHNLAEPAYEADVAQLEYKLVAGEHGLIIRVKGFNHKLPLLFQLIIDYLAEFNSTPAVFTMITEQLKKTYFNILIKPETLAKDVRLLILEYARWSMIDKYQALMDGLSLESLLSFVKEFKSQLFVEGLVQGNVTSTESMDFLKYVVDKLNFKPLEQEMPVQFQVVELPSGHHLCKVKALNKGDANSEVTVYYQSGTRSLREYTLMELLVMHMEEPCFDFLRTKQTLGYHVYPTCRNTSGILGFSVTVGTQATKYNSEVVDKKIEEFLSSFEEKIENLTEEAFNTQVTALIKLKECEDTHLGEEVDRNWNEVVTQQYLFDRLAHEIEALKSFSKSDLVNWFKAHRGPGSKMLSVHVVGYGKYELEEDGTPSSEDSNSSCEVMQLTYLPTSPLLADCIIPITDIRAFTTTLNLLPYHKIVK

SEQ ID NO: 1528 - protein, 324 aa, Homo sapiens
MSSEAETQQPPAAPPAAPALSAADTKPGTTGSGAGSGGPGGLTSAAPAGGDKKVIATKVLGTVKWFNVRNGYGFINRNDTKEDVFVHQTAIKKNNPRKYLRSVGDGETVEFDVVEGEKGAEAANVTGPGGVPVQGSKYAADRNHYRRYPRRRGPPRNYQQNYQNSESGEKNEGSESAPEGQAQQRRPYRRRRFPPYYMRRPYGRRPQYSNPPVQGEVMEGADNQGAGEQGRPVRQNMYRGYRPRFRRGPPRQRQPREDGNEEDKENQGDETQGQQPPQRRYRRNFNYRRRRPENPKPQDGKETKAADPPAENSSAPEAEQGGAE

SEQ ID NO: 1529 - protein, 187 aa, Homo sapiens
MPVDLSKWSGPLSLQEVDEQPQHPLHVTYAGAAVDELGKVLTPTQVKNRPTSISWDGLDSGKLYTLVLTDPDAPSRKDPKYREWHHFLVVNMKGNDISSGTVLSDYVGSGPPKGTGLHRYVWLVYEQDRPLKCDEPILSNRSGDHRGKFKVASFRKKYELRAPVAGTCYQAEWDDYVPKLYEQLSGK

SEQ ID NO: 1530 - protein, 531 aa, Homo sapiens
MSKPHSEAGTAFIQTQQLHAAMADTFLEHMCRLDIDSPPITARNTGIICTIGPASRSVETLKEMIKSGMNVARLNFSHGTHEYHAETIKNVRTATESFASDPILYRPVAVALDTKGPEIRTGLIKGSGTAEVELKKGATLKITLDNAYMEKCDENILWLDYKNICKVVEVGSKIYVDDGLISLQVKQKGADFLVTEVENGGSLGSKKGVNLPGAAVDLPAVSEKDIQDLKFGVEQDVDMVFASFIRKASDVHEVRKVLGEKGKNIKIISKIENHEGVRRFDEILEASDGIMVARGDLGIEIPAEKVFLAQKMMIGRCNRAGKPVICATQMLESMIKKPRPTRAEGSDVANAVLDGADCIMLSGETAKGDYPLEAVRMQHLIAREAEAAIYHLQLFEELRRLAPITSDPTEATAVGAVEASFKCCSGAIIVLTKSGRSAHQVARYRPRAPIIAVTRNPQTARQAHLYRGIFPVLCKDPVQEAWAEDVDLRVNFAMNVGKARGFFKKGDVVIVLTGWRPGSGFTNTMRVVPVP

SEQ ID NO: 1531 - protein, 370 aa, Homo sapiens
MSHPSPQAKPSNPSNPRVFFDVDIGGERVGRIVLELFADIVPKTAENFRALCTGEKGIGHTTGKPLHFKGCPFHRIIKKFMIQGGDFSNQNGTGGESIYGEKFEDENFHYKHDREGLLSMANAGRNTNGSQFFITTVPTPHLDGKHVVFGQVIKGIGVARILENVEVKGEKPAKLCVIAECGELKEGDDGGIFPKDGSGDSHPDFPEDADIDLKDVDKILLITEDLKNIGNTFFKSQNWEMAIKKYAEVLRYVDSSKAVIETADRAKLQPIALSCVLNIGACKLKMSNWQGAIDSCLEALELDPSNTKALYRRAQGWQGLKEYDQALADLKKAQGIAPEDKAIQAELLKVKQKIKAQKDKEKAVYAKMFA

SEQ ID NO: 1532 - protein, 255 aa, Homo sapiens
MSSIGTGYDLSASTFSPDGRVFQVEYAMKAVENSSTAIGIRCKDGVVFGVEKLVLSKLYEEGSNKRLFNVDRHVGMAVAGLLADARSLADIAREEASNFRSNFGYNIPLKHLADRVAMYVHAYTLYSAVRPFGCSFMLGSYSVNDGAQLYMIDPSGVSYGYWGCAIGKARQAAKTEIEKLQMKEMTCRDIVKEVAKIIYIVHDEVKDKAFELELSWVGELTNGRHEIVPKDIREEAEKYAKESLKEEDESDDDNM

SEQ ID NO: 1533 - protein, 288 aa, Homo sapiens [sequence omitted]

SEQ ID NO: 1534 - protein, 248 aa, Homo sapiens
MEGVEEKKKEVPAVPETLKKKRRNFAELKIKRLRKKFAQKMLRKARRKLIYEKAKHYHKEYRQMYRTEIRMARMARKAGNFYVPAEPKLAFVIRIRGINGVSPKVRKVLQLLRLRQIFNGTFVKLNKASINMLRIVEPYIAWGYPNLKSVNELIYKRGYGKINKKRIALTDNALIARSLGKYGIICMEDLIHEIYTVGKRFKEANNFLWPFKLSSPRGGMKKKTTHFVEGGDAGNREDQINRLIRRMN

SEQ ID NO: 1535 - protein, 266 aa, Homo sapiens [sequence omitted]

SEQ ID NO: 1536 - protein, 257 aa, Homo sapiens [sequence omitted]

SEQ ID NO: 1537 - protein, 293 aa, Homo sapiens [sequence omitted]

SEQ ID NO: 1538 - protein, 264 aa, Homo sapiens [sequence omitted]

SEQ ID NO: 1539 - protein, 1392 aa, Homo sapiens
MSMLKPSGLKAPTKILKPGSTALKTPTAVVAPVEKTISSEKASSTPSSETQEEFVDDFRVGERVWVNGNKPGFIQFLGETQFAPGQWAGIVLDEPIGKNDGSVAGVRYFQCEPLKGIFTRPSKLTRKVQAEDEANGLQTTPASRATSPLCTSTASMVSSSPSTPSNIPQKPSQPAAKEPSATPPISNLTKTASESISNLSEAGSIKKGERELKIGDRVLVGGTKAGVVRFLGETDFAKGEWCGVELDEPLGKNDGAVAGTRYFQCQPKYGLFAPVHKVTKIGFPSTTPAKAKANAVRRVMATTSASLKRSPSASSLSSMSSVASSVSSRPSRTGLLTETSSRYARKISGTTALQEALKEKQQHIEQLLAERDLERAEVAKATSHVGEIEQELALARDGHDQHVLELEAKMDQLRTMVEAADREKVELLNQLEEEKRKVEDLQFRVEEESITKGDLEVATVSEKSRIMELEKDLALRVQEVAELRRRLESNKPAGDVDMSLSLLQEISSLQEKLEVTRTDHQREITSLKEHFGAREETHQKEIKALYTATEKLSKENESLKSKLEHANKENSDVIALWKSKLETAIASHQQAMEELKVSFSKGLGTETAEFAELKTQIEKMRLDYQHEIENLQNQQDSERAAHAKEMEALRAKLMKVIKEKENSLEAIRSKLDKAEDQHLVEMEDTLNKLQEAEIKVKELEVLQAKCNEQTKVIDNFTSQLKATEEKLLDLDALRKASSEGKSEMKKLRQQLEAAEKQIKHLEIEKNAESSKASSITRELQGRELKLTNLQENLSEVSQVKETLEKELQILKEKFAEASEEAVSVQRSMQETVNKLHQKEEQFNMLSSDLEKLRENLADMEAKFREKDEREEQLIKAKEKLENDIAEIMKMSGDNSSQLTKMNDELRLKERDVEELQLKLTKANENASFLQKSIEDMTVKAEQSQQEAAKKHEEEKKELERKLSDLEKKMETSHNQCQELKARYERATSETKTKHEEILQNLQKTLLDTEDKLKGAREENSGLLQELEELRKQADKAKAAQTAEDAMQIMEQMTKEKTETLASLEDTKQTNAKLQNELDTLKENNLKNVEELNKSKELLTVENQKMEEFRKEIETLKQAAAQKSQQLSALQEENVKLAEELGRSRDEVTSHQKLEEERSVLNNQLLEMKKRESKFIKDADEEKASLQKSISITSALLTEKDAELEKLRNEVTVLRGENASAKSLHSVVQTLESDKVKLELKVKNLELQLKENKRQLSSSSGNTDTQADEDERAQESQIDFLNSVIVDLQRKNQDLKMKVEMMSEAALNGNGDDLNNYDSDDQEKQSKKKPRLFCDICDCFDLHDTEDCPTQAQMSEDPPHSTHHGSRGEERPYCEICEMFGHWATNCNDDETF

SEQ ID NO: 1540 - protein, 968 aa, Homo sapiens
MAFANFRRILRLSTFEKRKSREYEHVRRDLDPNEVWEIVGELGDGAFGKVYKAKNKETGALAAAKVIETKSEEELEDYIVEIEILATCDHPYIVKLLGAYYHDGKLWIMIEFCPGGAVDAIMLELDRGLTEPQIQVVCRQMLEALNFLHSKRIIHRDLKAGNVLMTLEGDIRLADFGVSAKNLKTLQKRDSFIGTPYWMAPEVVMCETMKDTPYDYKADIWSLGITLIEMAQIEPPHHELNPMRVLLKIAKSDPPTLLTPSKWSVEFRDFLKIALDKNPETRPSAAQLLEHPFVSSITSNKALRELVAEAKAEVMEEIEDGRDEGEEEDAVDAASTLENHTQNSSEVSPPSLNADKPLEESPSTPLAPSQSQDSVNEPCSQPSGDRSLQTTSPPVVAPGNENGLAVPVPLRKSRPVSMDARIQVAQEKQVAEQGGDLSPAANRSQKASQSRPNSSALETLGGEKLANGSLEPPAQAAPGPSKRDSDCSSLCTSESMDYGTNLSTDLSLNKEMGSLSIKDPKLYKKTLKRTRKFVVDGVEVSITTSKIISEDEKKDEEMRFLRRQELRELRLLQKEEHRNQTQLSNKHELQLEQMHKRFEQEINAKKKFFDTELENLERQQKQQVEKMEQDHAVRRREEARRIRLEQDRDYTRFQEQLKLMKKEVKNEVEKLPRQQRKESMKQKMEEHTQKKQLLDRDFVAKQKEDLELAMKRLTTDNRREICDKERECLMKKQELLRDREAALWEMEEHQLQERHQLVKQQLKDQYFLQRHELLRKHEKEREQMQRYNQRMIEQLKVRQQQEKARLPKIQRSEGKTRMAMYKKSLHINGGGSAAEQREKIKQFSQQEEKRQKSERLQQQQKHENQMRDMLAQCESNMSELQQLQNEKCHLLVEHETQKLKALDESHNQNLKEWRDKLRPRKKALEEDLNQKKREQEMFFKLSEEAECPNPSTPSKAAKFFPYSSADAS

SEQ ID NO: 1541 - protein, 264 aa, Homo sapiens [sequence omitted]

SEQ ID NO: 1542 - protein, 198 aa, Homo sapiens
MASGNARIGKPAPDFKATAVVDGAFKEVKLSDYKGKYVVLFFYPLDFTFVCPTEIIAFSNRAEDFRKLGCEVLGVSVDSQFTHLAWINTPRKEGGLGPLNIPLLADVTRRLSEDYGVLKTDEGIAYRGLFIIDGKGVLRQITVNDLPVGRSVDEALRLVQAFQYTDEHGEVCPAGWKPGSDTIKPNVDDSKEYFSKHN

SEQ ID NO: 1543 - protein, 761 aa, Homo sapiens
MDSGGGSLGLHTPDSRMAHTMIMQDFVAGMAGTAHIDGDHIVVSVPEAVLVSDVVTDDGITLDHGLAAEVVHGPDIITETDVVTEGVIVPEAVLEADVAIEEDLEEDDGDHILTSELITETVRVPEQVFVADLVTGPNGHLEHVVQDCVSGVDSPTMVSEEVLVTNSDTETVIQAAGGVPGSTVTIKTEDDDDDDVKSTSEDYLMISLDDVGEKLEHMGNTPLKIGSDGSQEDAKEDGFGSEVIKVYIFKAEAEDDVEIGGTEIVTESEYTSGHSVAGVLDQSRMQREKMVYMAVKDSSQEEDDIRDERRVSRRYEDCQASGNTLDSALESRSSTAAQYLQICDGINTNKVLKQKAKKRRRGETRQWQTAVIIGPDGQPLTVYPCHICTKKFKSRGFLKRHMKNHPDHLMRKKYQCTDCDFTTNKKVSFHNHLESHKLINKVDKTHEFTEYTRRYREASPLSSNKLILRDKEPKMHKCKYCDYETAEQGLLNRHLLAVHSKNFPHVCVECGKGFRHPSELKKHMRTHTGEKPYQCQYCIFRCADQSNLKTHIKSKHGNNLPYKCEHCPQAFGDERELQRHLDLFQGHKTHQCPHCDHKSTNSSDLKRHIISVHTKDFPHKCEVCDKGFHRPSELKKHSDIHKGRKIHQCRHCDFKTSDPFILSGHILSVHTKDQPLKCKRCKRGFRQQNELKKHMKTHTGRKIYQCEYCEYSTTDASGFKRHVISIHTKDYPHRCEFCKKGFRRPSEKNQHIMRHHKEALM

SEQ ID NO: 1544 - protein, 235 aa, Homo sapiens
MNIRNARPEDLMNMQHCNLLCLPENYQMKYYFYHGLSWPQLSYIAEDENGKIVGYVLAKMEEDPDDVPHGHITSLAVKRSHRRLGLAQKLMDQASRAMIENFNAKYVSLHVRKSNRAALHLYSNTLNFQISEVEPKYYADGEDAYAMKRDLTQMADELRRHLELKEKGRHVVLGAIENKVESKGNSPPSSGEACREEKGLAAEDSGGDSKDLSEVSETTESTDVKDSSEASDSAS

SEQ ID NO: 1545 - protein, 574 aa, Homo sapiens
MEASLGIQMDEPMAFSPQRDRFQAEGSLKKNEQNFKLAGVKKDIEKLYEAVPQLSNVFKIEDKIGEGTFSSVYLATAQLQVGPEEKIALKHLIPTSHPIRIAAELQCLTVAGGQDNVMGVKYCFRKNDHVVIAMPYLEHESFLDILNSLSFQEVREYMLNLFKALKRIHQFGIVHRDVKPSNFLYNRRLKKYALVDFGLAQGTHDTKIELLKFVQSEAQQERCSQNKSHIITGNKIPLSGPVPKELDQQSTTKASVKRPYTNAQIQIKQGKDGKEGSVGLSVQRSVFGERNFNIHSSISHESPAVKLMKQSKTVDVLSRKLATKKKAISTKVMNSAVMRKTASSCPASLTCDCYATDKVCSICLSRRQQVAPRAGTPGFRAPEVLTKCPNQTTAIDMWSAGVIFLSLLSGRYPFYKASDDLTALAQIMTIRGSRETIQAAKTFGKSILCSKEVPAQDLRKLCERLRGMDSSTPKLTSDIQGHASHQPAISEKTDHKASCLVQTPPGQYSGNSFKKGDSNSCEHCFDEYNTNLEGWNEVPDEAYDLLDKLLDLNPASRITAEEALLHPFFKDMSL

SEQ ID NO: 1546 - protein, 352 aa, Homo sapiens
MASRKEGTGSTATSSSSTAGAAGKGKGKGGSGDSAVKQVQIDGLVVLKIIKHYQEEGQGTEVVQGVLLGLVVEDRLEITNCFPFPQHTEDDADFDEVQYQMEMMRSLRHVNIDHLHVGWYQSTYYGSFVTRALLDSQFSYQHAIEESVVLIYDPIKTAQGSLSLKAYRLTPKLMEVCKEKDFSPEALKKANITFEYMFEEVPIVIKNSHLINVLMWELEKKSAVADKHELLSLASSNHLGKNLQLLMDRVDEMSQDIVKYNTYMRNTSKQQQQKHQYQQRRQQENMQRQSRGEPPLPEEDLSKLFKPPQPPARMDSLLIAGQINTYCQNIKEFTAQNLGKLFMAQALQEYNN

SEQ ID NO: 1547 - protein, 1462 aa, Homo sapiens
MSKVIQKKNHWTSRVHECTVKRGPQGELGVTVLGGAEHGEFPYVGAVAAVEAAGLPGGGEGPRLGEGELLLEVQGVRVSGLPRYDVLGVIDSCKEAVTFKAVRQGGRLNKDLRHFLNQRFQKGSPDHELQQTIRDNLYRHAVPCTTRSPREGEVPGVDYNFLTVKEFLDLEQSGTLLEVGTYEGNYYGTPKPPSQPVSGKVITTDALHSLQSGSKQSTPKRTKSYNDMQNAGIVHAENEEEDDVPEMNSSFTADSGEQEEHTLQETALPPVNSSIIAAPITDPSQKFPQYLPLSAEDNLGPLPENWEMAYTENGEVYFIDHNTKTTSWLDPRCLNKQQKPLEECEDDEGVHTEELDSELELPAGWEKIEDPVYGIYYVDHINRKTQYENPVLEAKRKKQLEQQQQQQQQQQQQQQQQQQQQTEEWTEDHSALVPPVIPNHPPSNPEPAREVPLQGKPFFTRNPSELKGKFIHTKLRKSSRGFGFTVVGGDEPDEFLQIKSLVLDGPAALDGKMETGDVIVSVNDTCVLGHTHAQVVKIFQSIPIGASVDLELCRGYPLPFDPDDPNTSLVTSVAILDKEPIIVNGQETYDSPASHSSKTGKVNGMKDARPSSPADVASNSSHGYPNDTVSLASSIATQPELITVHIVKGPMGFGFTIADSPGGGGQRVKQIVDSPRCRGLKEGDLIVEVNKKNVQALTHNQVVDMLVECPKGSEVTLLVQRGGLPVPKKSPKSQPLERKDSQNSSQHSVSSHRSLHTASPSHSTQVLPEFPPAEAQAPDQTDSSGQKKPDPFKIWAQSRSMYENRLPDYQEQDIFLWRKETGFGFRILGGNEPGEPIYIGHIVPLGAADTDGRLRSGDELICVDGTPVIGKSHQLVVQLMQQAAKQGHVNLTVRRKVVFAVPKTENEVPSPASSHHSSNQPASLTEEKRTPQGSQNSLNTVSSGSGSTSGIGSGGGGGSGVVSTVVQPYDVEIRRGENEGFGFVIVSSVSRPEAGTTFGNACVAMPHKIGRIIEGSPADRCGKLKVGDRILAVNGCSITNKSHSDIVNLIKEAGNTVTLRIIPGDESSNATLLTNAEKIATITTTHTPSQQGTQETRNTTKPKQESQFEFKAPQATQEQDFYTVELERGAKGFGFSLRGGREYNMDLYVLRLAEDGPAERCGKMRIGDEILEINGETTKNMKHSRAIELIKNGGRRVRLFLKRGDGSVPEYDPSSDRHGPATGPQGVPEVRAGPDRRQHPSLESSYPPDLHKSSPHGEKRAHARDPKGSREYSRQPNEHHTWNGTSRKPDSGACRPKDRAPEGRRDAQAERAAAANGPKRRSPEKRREGTRSADNTLERREKHEKRRDVSPERRRERSPTRRRDGSPSRRRRSLERLLEQRRSPERRRGGSPERRAKSTDRRRARSPERRRERSLDKRNREDRASHREREEANLKQDAGRSSRHPPEQRRRPYKECSTDLSI

SEQ ID NO: 1548 - protein, 218 aa, Homo sapiens
MGTRDDEYDYLFKVVLIGDSGVGKSNLLSRFTRNEFNLESKSTIGVEFATRSIQVDGKTIKAQIWDTAGQERYRAITSAYYRGAVGALLVYDIAKHLTYENVERWLKELRDHADSNIVIMLVGNKSDLRHLRAVPTDEARAFAEKNNLSFIETSALDSTNVEEAFKNILTEIYRIVSQKQIADRAAHDESPGNNVVDISVPPTTDGQKPNKLQCCQNL

SEQ ID NO: 1549 - protein, 309 aa, Homo sapiens
MDALTANGTTNIQTSVTGVTASKRKFIDDRRDQPFDKRLRFSVRQTESAYRYRDIVVRKQDGFTHILLSTKSSENNSLNPEVMREVQSALSTAAADDSKLVLLSAVGSVFCCGLDFIYFIRRLTDDRKRESTKMAEAIRNFVNTFIQFKKPIIVAVNGPAIGLGASILPLCDVVWANEKAWFQTPYTTFGQSPDGCSTVMFPKIMGGASANEMLLSGRKLTAQEACGKGLVSQVFWPGTFTQEVMVRIKELASCNPVVLEESKALVRCNMKMELEQANERECEVLKKIWGSAQGTDSMLKYMQRKIDEF

SEQ ID NO: 1550 - protein, 297 aa, Homo sapiens
MAKVSELYDVTWEEMRDKMRKWREENSRNSEQIVEVGEELINEYASKLGDDIWIIYEQVMIAALDYGRDDLALFCLQELRRQFPGSHRVKRLTGMRFEAMERYDDAIQLYDRILQEDPTNTAARKRKIAIRKAQGKNVEAIRELNEYLEQFVGDQEAWHELAELYINEHDYAKAAFCLEELMMTNPHNHLYCQQYAEVKYTQGGLENLELSRKYFAQALKLNNRNMRALFGLYMSASHIASNPKASAKTKKDNMKYASWAASQINRAYQFAGRSKKETKYSLKAVEDMLETLQITQS

SEQ ID NO: 1551 - protein, 4374 aa, Homo sapiens
MKVDRTKLKKTPTEAPADCRALIDKLKVCNDEQLLLELQQIKTWNIGKCELYHWVDLLDRFDGILADAGQTVENMSWMLVCDRPEREQLKMLLLAVLNFTALLIEYSFSRHLYSSIEHLTTLLASSDMQVVLAVLNLLYVFSKRSNYITRLGSDKRTPLLTRLQHLAESWGGKENGFGLAECCRDLHMMKYPPSATTLHFEFYADPGAEVKIEKRTTSNTLHYIHIEQLDKISESPSEIMESLTKMYSIPKDKQMLLFTHIRLAHGFSNHRKRLQAVQARLHAISILVYSNALQESANSILYNGLIEELVDVLQITDKQLMEIKAASLRTLTSIVHLERTPKLSSIIDCTGTASYHGFLPVLVRNCIQAMIDPSMDPYPHQFATALFSFLYHLASYDAGGEALVSCGMMEALLKVIKFLGDEQDQITFVTRAVRVVDLITNLDMAAFQSHSGLSIFIYRLEHEVDLCRKECPFVIKPKIQRPNTTQEGEEMETDMDGVQCIPQRAALLKSMLNFLKKAIQDPAFSDGIRHVMDGSLPTSLKHIISNAEYYGPSLFLLATEVVTVFVFQEPSLLSSLQDNGLTDVMLHALLIKDVPATREVLGSLPNVFSALCLNARGLQSFVQCQPFERLFKVLLSPDYLPAMRRRRSSDPLGDTASNLGSAVDELMRHQPTLKTDATTAIIKLLEEICNLGRDPKYICQKPSIQKADGTATAPPPRSNHAAEEASSEDEEEEEVQAMQSFNSTQQNETEPNQQVVGTEERIPIPLMDYILNVMKFVESILSNNTTDDHCQEFVNQKGLLPLVTILGLPNLPIDFPTSAACQAVAGVCKSILTLSHEPKVLQEGLLQLDSILSSLEPLHRPIESPGGSVLLRELACAGNVADATLSAQATPLLHALTAAHAYIMMFVHTCRVGQSEIRSISVNQWGSQLGLSVLSKLSQLYCSLVWESTVLLSLCTPNSLPSGCEFGQADMQKLVPKDEKAGTTQGGKRSDGEQDGAAGSMDASTQGLLEGIGLDGDTLAPMETDEPTASDSKGKSKITPAMAARIKQIKPLLSASSRLGRALAELFGLLVKLCVGSPVRQRRSHHAASTTTAPTPAARSTASALTKLLTKGLSWQPPPYTPTPRFRLTFFICSVGFTSPMLFDERKYPYHLMLQKFLCSGGHNALFETFNWALSMGGKVPVSEGLEHSDLPDGTGEFLDAWLMLVEKMVNPTTVLESPHSLPAKLPGGVQNFPQFSALRFLVVTQKAAFTCIKNLWNRKPLKVYGGRMAESMLAILCHILRGEPVIRERLSKEKEGSRGEEDTGQEEGGSRREPQVNQQQLQQLMDMGFTREHAMEALLNTSTMEQATEYLLTHPPPIMGGVVRDLSMSEEDQMMRAIAMSLGQDIPMDQRAESPEEVACRKEEEERKAREKQEEEEAKCLEKFQDADPLEQDELHTFTDTMLPGCFHLLDELPDTVYRVCDLIMTAIKRNGADYRDMILKQVVNQVWEAADVLIKAALPLTTSDTKTVSEWISQMATLPQASNLATRILLLTLLFEELKLPCAWVVESSGILNVLIKLLEVVQPCLQAAKEQKEVQTPKWITPVLLLIDFYEKTAISSKRRAQMTKYLQSNSNNWRWFDDRSGRWCSYSASNNSTIDSAWKSGETSVRFTAGRRRYTVQFTTMVQVNEETGNRRPVMLTLLRVPRLNKNSKNSNGQELEKTLEESKEMDIKRKENKGNDTPLALESTNTEKETSLEETKIGEILIQGLTEDMVTVLIRACVSMLGVPVDPDTLHATLRLCLRLTRDHKYAMMFAELKSTRMILNLTQSSGFNGFTPLVTLLLRHIIEDPCTLRHTMEKVVRSAATSGAGSTTSGVVSGSLGSREINYILRVLGPAACRNPDIFTEVANCCIRIALPAPRGSGTASDDEFENLRIKGPNAVQLVKTTPLKPSPLPVIPDTIKEVIYDMLNALAAYHAPEEADKSDPKPGVMTQEVGQLLQDMGDDVYQQYRSLTRQSSDFDTQSGFSINSQVFAADGASTETSASGTSQGEASTPEESRDGKKDKEGDRASEEGKQKGKGSKPLMPTSTILRLLAELVRSYVGIATLIANYSYTVGQSELIKEDCSVLAFVLDHLLPHTQNAEDKDTPALARLFLASLAAAGSGTDAQVALVNEVKAALGRALAMAESTEKHARLQAVMCIISTIMESCPSTSSFYSSATAKTQHNGMNNIIRLFLKKGLVNDLARVPHSLDLSSPNMANTVNAALKPLETLSRIVNQPSSLFGSKSASSKNKSEQDAQGASQDSSSNQQDPGEPGEAEVQEEDHDVTQTEVADGDIMDGEAETDSVVIAGQPEVLSSQEMQVENELEDLIDELLERDGGSGNSTIIVSRSGEDESQEDVLMDEAPSNLSQASTLQANREDSMNILDPEDEEEHTQEEDSSGSNEDEDDSQDEEEEEEEDEEDDQEDDEGEEGDEDDDDDGSEMELDEDYPDMNASPLVRFERFDREDDLIIEFDNMFSSATDIPPSPGNIPTTHPLMVRHADHSSLTLGSGSSTTRLTQGIGRSQRTLRQLTANTGHTIHVHYPGNRQPNPPLILQRLLGPSAAADILQLSSSLPLQSRGRARLLVGNDDVHIIARSDDELLDDFFHDQSTATSQAGTLSSIPTALTRWTEECKVLDAESMHDCVSVVKVSIVNHLEFLRDEELEERREKRRKQLAEEETKITDKGKEDKENRDQSAQCTASKSNDSTEQNLSDGTPMPDSYPTTPSSTDAATSESKETLGTLQSSQQQPTLPTPPALGEVPQELQSPAGEGGSSTQLLMPVEPEELGPTRPSGEAETTQMELSPAPTITSLSPERAEDSDALTAVSSQLEGSPMDTSSLASCTLEEAVGDTSAAGSSEQPRAGSSTPGDAPPAVAEVQGRSDGSGESAQPPEDSSPPASSESSSTRDSAVAISGADSRGILEEPLPSTSSEEEDPLAGISLPEGVDPSFLAALPDDIRREVLQNQLGIRPPTRTAPSTNSSAPAVVGNPGVTEVSPEFLAALPPAIQEEVLAQQRAEQQRRELAQNASSDTPMDPVTFIQTLPSDLRRSVLEDMEDSVLAVMPPDIAAEAQALRREQEARQRQLMHERLFGHSSTSALSAILRSPAFTSRLSGNRGVQYTRLAVQRGGTFQMGGSSSHNRPSGSNVDTLLRLRGRLLLDHEALSCLLVLLFVDEPKLNTSRLHRVLRNLCYHAQTRHWVIRSLLSILQRSSESELCIETPKLTTSEEKGKKSSKSCGSSSHENRPLDLLHKMESKSSNQLSWLSVSMDAALGCRTNIFQIQRSGGRKHTEKHASGGSTVHIHPQAAPVVCRHVLDTLIQLAKVFPSHFTQQRTKETNCESDRERGNKACSPCSSQSSSSGICTDFWDLLVKLDNMNVSRKGKNSVKSVPVSAGGEGETSPYSLEASPLGQLMNMLSHPVIRRSSLLTEKLLRLLSLISIALPENKVSEAQANSGSGASSTTTATSTTSTTTTTAASTTPTPPTAPTPVTSAPALVAATAISTIVVAASTTVTTPTTATTTVSISPTTKGSKSPAKVSDGGSSSTDFKMVSSGLTENQLQLSVEVLTSHSCSEEGLEDAANVLLQLSRGDSGTRDTVLKLLLNGARHLGYTLCKQIGTLLAELREYNLEQQRRAQCETLSPDGLPEEQPQTTKLKGKMQSRFDMAENVVIVASQKRPLGGRELQLPSMSMLTSKTSTQKFFLRVLQVIIQLRDDTRRANKKAKQTGRLGSSGLGSASSIQAAVRQLEAEADAIIQMVREGQRARRQQQAATSESSQSEASVRREESPMDVDQPSPSAQDTQSIASDGTPQGEKEKEERPPELPLLSEQLSLDELWDMLGECLKELEESHDQHAVLVLQPAVEAFFLVHATERESKPPVRDTRESQLAHIKDEPPPLSPAPLTPATPSSLDPFFSREPSSMHISSSLPPDTQKFLRFAETHRTVLNQILRQSTTHLADGPFAVLVDYIRVLDFDVKRKYFRQELERLDEGLRKEDMAVHVRRDHVFEDSYRELHRKSPEEMKNRLYIVFEGEEGQDAGGLLREWYMIISREMFNPMYALFRTSPGDRVTYTINPSSHCNPNHLSYFKFVGRIVAKAVYDNRLLECYFTRSFYKHILGKSVRYTDMESEDYHFYQGLVYLLENDVSTLGYDLTFSTEVQEFGVCEVRDLKPNGANILVTEENKKEYVHLVCQMRMTGAIRKQLAAFLEGFYEIIPKRLISIFTEQELELLISGLPTIDIDDLKSNTEYHKYQSNSIQIQWFWRALRSFDQADRAKFLQFVTGTSKVPLQGFAALEGMNGIQKFQIHRDDRSTDRLPSAHTCFNQLDLPAYESFEKLRHMLLLAIQECSEGFGLA

SEQ ID NO: 1552 - protein, 300 aa, Homo sapiens
MILLEVNNRIIEETLALKFENAAAGNKPEAVEVTFADFDGVLYHISNPNGDKTKVMVSISLKFYKELQAHGADELLKRVYGSFLVNPESGYNVSLLYDLENLPASKDSIVHQAGMLKRNCFASVFEKYFQFQEEGKEGENRAVIHYRDDETMYVESKKDRVTVVFSTVFKDDDDVVIGKVFMQEFKEGRRASHTAPQVLFSHREPPLELKDTDAAVGDNIGYITFVLFPRHTNASARDNTINLIHTFRDYLHYHIKCSKAYIHTRMRAKTSDFLKVLNRARPDAEKKEMKTITGKTFSSR

SEQ ID NO: 1553 - protein, 1123 aa, Homo sapiens
MWGDSRPANRTGPFRGSQEERFAPGWNRDYPPPPLKSHAQERHSGNFPGRDSLPFDFQGHSGPPFANVEEHSFSYGARDGPHGDYRGGEGPGHDFRGGDFSSSDFQSRDSSQLDFRGRDIHSGDFRDREGPPMDYRGGDGTSMDYRGREAPHMNYRDRDAHAVDFRGRDAPPSDFRGRGTYDLDFRGRDGSHADFRGRDLSDLDFRAREQSRSDFRNRDVSDLDFRDKDGTQVDFRGRGSGTTDLDFRDRDTPHSDFRGRHRSRTDQDFRGREMGSCMEFKDREMPPVDPNILDYIQPSTQDREHSGMNVNRREESTHDHTIERPAFGIQKGEFEHSETREGETQGVAFEHESPADFQNSQSPVQDQDKSQLSGREEQSSDAGLFKEEGGLDFLGRQDTDYRSMEYRDVDHRLPGSQMFGYGQSKSFPEGKTARDAQRDLQDQDYRTGPSEEKPSRLIRLSGVPEDATKEEILNAFRTPDGMPVKNLQLKEYNTGYDYGYVCVEFSLLEDAIGCMEANQGTLMIQDKEVTLEYVSSLDFWYCKRCKANIGGHRSSCSFCKNPREVTEAKQELITYPQPQKTSIPAPLEKQPNQPLRPADKEPEPRKREEGQESRLGHQKREAERYLPPSRREGPTFRRDRERESWSGETRQDGESKTIMLKRIYRSTPPEVIVEVLEPYVRLTTANVRIIKNRTGPMGHTYGFIDLDSHAEALRVVKILQNLDPPFSIDGKMVAVNLATGKRRNDSGDHSDHMHYYQGKKYFRDRRGGGRNSDWSSDTNRQGQQSSSDCYIYDSATGYYYDPLAGTYYDPNTQQEVYVPQDPGLPEEEEIKEKKPTSQGKSSSKKEMSKRDGKEKKDRGVTRFQENASEGKAPAEDVFKKPLPPTVKKEESPPPPKVVNPLIGLLGEYGGDSDYEEEEEEEQTPPPQPRTAQPQKREEQTKKENEEDKLTDWNKLACLLCRRQFPNKEVLIKHQQLSDLHKQNLEIHRKIKQSEQELAYLERREREGKFKGRGNDRREKLQSFDSPERKRIKYSRETDSDRKLVDKEDIDTSSKGGCVQQATGWRKGTGLGYGHPGLASSEEAEGRMRGPSVGASGRTSKRQSNETYRDAVRRVMFARYKELD

SEQ ID NO: 1554 - protein, 303 aa, Homo sapiens
MKGKEEKEGGARLGAGGGSPEKSPSAQELKEQGNRLFVGRKYPEAAACYGRAITRNPLVAVYYTNRALCYLKMQQHEQALADCRRALELDGQSVKAHFFLGQCQLEMESYDEAIANLQRAYSLAKEQRLNFGDDIPSALRIAKKKRWNSIEERRIHQESELHSYLSRLIAAERERELEECQRNHEGDEDDSHVRAQQACIEAKHDKYMADMDELFSQVDEKRKKRDIPDYLCGKISFELMREPCITPSGITYDRKDIEEHLQRVGHFDPVTRSPLTQEQLIPNLAMKEVIDAFISENGWVEDY

SEQ ID NO: 1555 - protein, 669 aa, Homo sapiens
MKIFVGNVDGADTTPEELAALFAPYGTVMSCAVMKQFAFVHMRENAGALRAIEALHGHELRPGRALVVEMSRPRPLNTWKIFVGNVSAACTSQELRSLFERRGRVIECDVVKDYAFVHMEKEADAKAAIAQLNGKEVKGKRINVELSTKGQKKGPGLAVQSGDKTKKPGAGDTAFPGTGGFSATFDYQQAFGNSTGGFDGQARQPTPPFFGRDRSPLRRSPPRASYVAPLTAQPATYRAQPSVSLGAAYRAQPSASLGVGYRTQPMTAQAASYRAQPSVSLGAPYRGQLASPSSQSAAASSLGPYGGAQPSASALSSYGGQAAAASSLNSYGAQGSSLASYGNQPSSYGAQAASSYGVRAAASSYNTQGAASSLGSYGAQAASYGAQSAASSLAYGAQAASYNAQPSASYNAQSAPYAAQQAASYSSQPAAYVAQPATAAAYASQPAAYAAQATTPMAGSYGAQPVVQTQLNSYGAQASMGLSGSYGAQSAAAATGSYGAAAAYGAQPSATLAAPYRTQSSASLAASYAAQQHPQAAASYRGQPGNAYDGAGQPSAAYLSMSQGAVANANSTPPPYERTRLSPPRASYDDPYKKAVAMSKRYGSDRRLAELSDYRRLSESQLSFRRSPTKSSLDYRRLPDAHSDYARYSGSYNDYLRAAQMHSGYQRRM

SEQ ID NO: 1556 - protein, 335 aa, Homo sapiens
MAAGAAEAAVAAVEEVGSAGQFEELLRLKAKSLLVVHFWAPWAPQCAQMNEVMAELAKELPQVSFVKLEAEGVPEVSEKYEISSVPTFLFFKNSQKIDRLDGAHAPELTKKVQRHASSGSFLPSANEHLKEDLNLRLKKLTHAAPCMLFMKGTPQEPRCGFSKQMVEILHKHNIQFSSFDIFSDEEVRQGLKAYSSWPTYPQLYVSGELIGGLDIIKELEASEELDTICPKAPKLEERLKVLTNKASVMLFMKGNKQEAKCGFSKQILEILNSTGVEYETFDILEDEEVRQGLKAYSNWPTYPQLYVKGELVGGLDIVKELKENGELLPILRGEN

SEQ ID NO: 1557 - protein, 713 aa, Homo sapiens
MAKSPENSTLEEILGQYQRSLREHASRSIHQLTCALKEGDVTIGEDAPNLSFSTSVGNEDARTAWPELQQSHAVNQLKDLLRQQADKESEVSPSRRRKMSPLRSLEHEETNMPTMHDLVHTINDQSQYIHHLEAEVKFCKEELSGMKNKIQVVVLENEGLQQQLKSQRQEETLREQTLLDASGNMHNSWITTGEDSGVGETSKRPFSHDNADFGKAASAGEQLELEKLKLTYEEKCEIEESQLKFLRNDLAEYQRTCEDLKEQLKHKEFLLAANTCNRVGGLCLKCAQHEAVLSQTHTNVHMQTIERLVKERDDLMSALVSVRSSLADTQQREASAYEQVKQVLQISEEANFEKTKALIQCDQLRKELERQAERLEKELASQQEKRAIEKDMMKKEITKEREYMGSKMLILSQNIAQLEAQVEKVTKEKISAINQLEEIQSQLASREMDVTKVCGEMRYQLNKTNMEKDEAEKEHREFRAKTNRDLEIKDQEIEKLRIELDESKQHLEQEQQKAALAREECLRLTELLGESEHQLHLTRQEKDSIQQSFSKEAKAQALQAQQREQELTQKIQQMEAQHDKTENEQYLLLTSQNTFLTKLKEECCTLAKKLEQISQKTRSEIAQLSQEKRYTYDKLGKLQRRNEELEEQCVQHGRVHETMKQRLRQLDKHSQATAQQLVQLLSKQNQLLLERQSLSEEVDRLRTQLPSMPQSDC

SEQ ID NO: 1558 - protein, 801 aa, Homo sapiens
MHHRMNEMNLSPVGMEQLTSSSVSNALPVSGSHLGLAASPTHSAIPAPGLPVAIPNLGPSLSSLPSALSLMLPMGIGDRGVMCGLPERNYTLPPPPYPHLESSYFRTILPGILSYLADRPPPQYIHPNSINVDGNTALSITNNPSALDPYQSNGNVGLEPGIVSIDSRSVNTHGAQSLHPSDGHEVALDTAITMENVSRVTSPISTDGMAEELTMDGVAGEHSQIPNGSRSHEPLSVDSVSNNLAADAVGHGGVIPMHGNGLELPVVMETDHIASRVNGMSDSALSDSIHTVAMSTNSVSVALSTSHNLASLESVSLHEVGLSLEPVAVSSITQEVAMGTGHVDVSSDSLSFVSPSLQMEDSNSNKENMATLFTIWCTLCDRAYPSDCPEHGPVTFVPDTPIESRARLSLPKQLVLRQSIVGAEVGVWTGETIPVRTCFGPLIGQQSHSMEVAEWTDKAVNHIWKIYHNGVLEFCIITTDENECNWMMFVRKARNREEQNLVAYPHDGKIFFCTSQDIPPENELLFYYSRDYAQQIGVPEHPDVHLCNCGKECNSYTEFKAHLTSHIHNHLPTQGHSGSHGPSHSKERKWKCSMCPQAFISPSKLHVHFMGHMGMKPHKCDFCSKAFSDPSNLRTHLKIHTGQKNYRCTLCDKSFTQKAHLESHMVIHTGEKNLKCDYCDKLFMRRQDLKQHVLIHTQERQIKCPKCDKLFLRTNHLKKHLNSHEGKRDYVCEKCTKAYLTKYHLTRHLKTCKGPTSSSSAPEEEEEDDSEEEDLADSVGTEDCRINSAVYSADESLSAHK

SEQ ID NO: 1559 - protein, 1078 aa, Homo sapiens
MAPRKRGGRGISFIFCCFRNNDHPEITYRLRNDSNFALQTMEPALPMPPVEELDVMFSELVDELDLTDKHREAMFALPAEKKWQIYCSKKKDQEENKGATSWPEFYIDQLNSMAARKSLLALEKEEEEERSKTIESLKTALRTKPMRFVTRFIDLDGLSCILNFLKTMDYETSESRIHTSLIGCIKALMNNSQGRAHVLAHSESINVIAQSLSTENIKTKVAVLEILGAVCLVPGGHKKVLQAMLHYQKYASERTRFQTLINDLDKSTGRYRDEVSLKTAIMSFINAVLSQGAGVESLDFRLHLRYEFLMLGIQPVIDKLREHENSTLDRHLDFFEMLRNEDELEFAKRFELVHIDTKSATQMFELTRKRLTHSEAYPHFMSILHHCLQMPYKRSGNTVQYWLLLDRIIQQIVIQNDKGQDPDSTPLENFNIKNVVRMLVNENEVKQWKEQAEKMRKEHNELQQKLEKKERECDAKTQEKEEMMQTLNKMKEKLEKETTEHKQVKQQVADLTAQLHELSRRAVCASIPGGPSPGAPGGPFPSSVPGSLLPPPPPPPLPGGMLPPPPPPLPPGGPPPPPGPPPLGAIMPPPGAPMGLALKKKSIPQPTNALKSFNWSKLPENKLEGTVWTEIDDTKVFKILDLEDLERTFSAYQRQQDFFVNSNSKQKEADAIDDTLSSKLKVKELSVIDGRRAQNCNILLSRLKLSNDEIKRAILTMDEQEDLPKDMLEQLLKFVPEKSDIDLLEEHKHELDRMAKADRFLFEMSRINHYQQRLQSLYFKKKFAERVAEVKPKVEAIRSGSEEVFRSGALKQLLEVVLAFGNYMNKGQRGNAYGFKISSLNKIADTKSSIDKNITLLHYLITIVENKYPSVLNLNEELRDIPQAAKVNMTELDKEISTLRSGLKAVETELEYQKSQPPQPGDKFVSVVSQFITVASFSFSDVEDLLAEAKDLFTKAVKHFGEEAGKIQPDEFFGIFDQFLQAVSEAKQENENMRKKKEEEERRARMEAQLKEQRERERKMRKAKENSEESGEFDDLVSALRSGEVFDKDLSKLKRNRKRITNQMTDSSRERPITKLNF

SEQ ID NO: 1560 - protein, 678 aa, Homo sapiens
MPTWGARPASPDRFAVSAEAENKVREQQPHVERIFSVGVSVLPKDCPDNPHIWLQLEGPKENASRAKEYLKGLCSPELQDEIHYPPKLHCIFLGAQGFFLDCLAWSTSAHLVPRAPGSLMISGLTEAFVMAQSRVEELAERLSWDFTPGPSSGASQCTGVLRDFSALLQSPGDAHREALLQLPLAVQEELLSLVQEASSGQGPGALASWEGRSSALLGAQCQGVRAPPSDGRESLDTGSMGPGDCRGARGDTYAVEKEGGKQGGPREMDWGWKELPGEEAWEREVALRPQSVGGGARESAPLKGKALGKEEIALGGGGFCVHREPPGAHGSCHRAAQSRGASLLQRLHNGNASPPRVPSPPPAPEPPWHCGDRGDCGDRGDVGDRGDKQQGMARGRGPQWKRGARGGNLVTGTQRFKEALQDPFTLCLANVPGQPDLRHIVIDGSNVAMVHGLQHYFSSRGIAIAVQYFWDRGHRDITVFVPQWRFSKDAKVRESHFLQKLYSLSLLSLTPSRVMDGKRISSYDDRFMVKLAEETDGIIVSNDQFRDLAEESEKWMAIIRERLLPFTFVGNLFMVPDDPLGRNGPTLDEFLKKPARTQGSSKAQHPSRGFAEHGKQQQGREEEKGSGGIRKTRETERLRRQLLEVFWGQDHKVDFILQREPYCRDINQLSEALLSLNF

SEQ ID NO: 1561 - protein, 147 aa, Homo sapiens
MSSEPPPPPQPPTHQASVGLLDTPRSRERSPSPLRGNVVPSPLPTRRTRTFSATVRASQGPVYKGVCKCFCRSKGHGFITPADGGPDIFLHISDVEGEYVPVEGDEVTYKMCSIPPKNEKLQAVEVVITHLAPGTKHETWSGHVISS

SEQ ID NO: 1562 - protein, 636 aa, Homo sapiens
MNPSAPSYPMASLYVGDLHPDVTEAMLYEKFSPAGPILSIRVCRDMITRRSLGYAYVNFQQPADAERALDTMNFDVIKGKPVRIMWSQRDPSLRKSGVGNIFIKNLDKSIDNKALYDTFSAFGNILSCKVVCDENGSKGYGFVHFETQEAAERAIEKMNGMLLNDRKVFVGRFKSRKEREAELGARAKEFTNVYIKNFGEDMDDERLKDLFGKFGPALSVKVMTDESGKSKGFGFVSFERHEDAQKAVDEMNGKELNGKQIYVGRAQKKVERQTELKRKFEQMKQDRITRYQGVNLYVKNLDDGIDDERLRKEFSPFGTITSAKVMMEGGRSKGFGFVCFSSPEEATKAVTEMNGRIVATKPLYVALAQRKEERQAHLTNQYMQRMASVRAVPNPVINPYQPAPPSGYFMAAIPQTQNRAAYYPPSQIAQLRPSPRWTAQGARPHPFQNMPGAIRPAAPRPPFSTMRPASSQVPRVMSTQRVANTSTQTMGPRPAAAAAAATPAVRTVPQYKYAAGVRNPQQHLNAQPQVTMQQPAVHVQGQEPLTASMLASAPPQEQKQMLGERLFPLIQAMHPTLAGKITGMLLEIDNSELLHMLESPESLRSKVDEAVAVLQAHQAKEAAQKAVNSATGVPTV

SEQ ID NO: 1563 - protein, 829 aa, Homo sapiens
MAEAEEQETGSLEESTDESEEEESEEEPKLKYERLSNGVTEILQKDAASCMTVHDKFLALGTHYGKVYLLDVQGNITQKFDVVQVFGLYSGEEFHETFDCPIKIIAVHPHFVRSSCKQFVTGGKKLLLFERSWMNRWKSAVLHEGEGNIRSVKWRGHLIAWANNMGVKIFDIISKQRITNVPRDDISLRPDMYPCSLCWKDNVTLIIGWGTSVKVCSVKERHASEMRDLPSRYVEIVSQFETEFYISGLAPLCDQLVVLSYVKEISEKTEREYCARPRLDIIQPLSETCEEISSDALTVRGFQENECRDYHLEYSEGESLFYIVSPRDVVVAKERDQDDHIDWLLEKKKYEEALMAAEISQKNIKRHKILDIGLAYINHLVERGDYDIAARKCQKILGKNAALWEYEVYKFKEIGQLKAISPYLPRGDPVLKPLIYEMILHEFLESDYEGFATLIREWPGDLYNNSVIVQAVRDHLKKDSQNKTLLKTLAELYTYDKNYGNALEIYLTLRHKDVFQLIHKHNLFSSIKDKIVLLMDFDSEKAVDMLLDNEDKISIKKVVEELEDRPELQHVYLHKLFKRDHHKGQRYHEKQISLYAEYDRPNLLPFLRDSTHCPLEKALEICQQRNFVEETVYLLSRMGNSRSALKMIMEELHDVDKAIEFAKEQDDGELWEDLILYSIDKPPFITGLLNNIGTHVDPILLIHRIKEGMEIPNLRDSLVKILQDYNLQILLREGCKKILVADSLSLLKKMHRTQMKGVLVDEENICESCLSPILPSDAAKPFSVVVFHCRHMFHKECLPMPSMNSAAQFCNICSAKNRGPGSAILEMKK

SEQ ID NO: 1564 - protein, 756 aa, Homo sapiens
MVVTRSARAKASIQAASAESSGQKSFAANGIQAHPESSTGSDARTTAESQTTGKQSLIPRTPKARKRKSRTTGSLPKGTEPSTDGETSEAESNYSVSEHHDTILRVTRRRQILIACSPVSSVRKKPKVTPTKESYTEEIVSEAESHVSGISRIVLPTEKTTGARRSKAKSLTDPSQESHTEAISDAETSSSDISFSGIATRRTRSMQRKLKAQTEKKDSKIVPGNEKQIVGTPVNSEDSDTRQTSHLQARSLSEINKPNFYNNDFDDDFSHRSSENILTVHEQANVESLKETKQNCKDLDEDANGITDEGKEINEKSSQLKNLSELQDTSLQQLVSQRHSTPQNKNAVSVHSNLNSEAVMKSLTQTFATVEVGRWNNNKKSPIKASDLTKFGDCGGSDDEEESTVISVSEDMNSEGNVDFECDTKLYTSAPNTSQGKDNSVLLVLSSDESQQSENSENEEDTLCFVENSGQRESLSGDTGSLSCDNALFVIDTTPGMSADKNFYLEEEDKASEVAIEEEKEEEEDEKSEEDSSDHDENEDEFSDEEDFLNSTKAKLLKLTSSSIDPGLSIKQLGGLYINFNADKLQSNKRTLTQIKEKKKNELLQKAVITPDFEKNHCVPPYSESKYQLQKKRRKERQKTAGDGWFGMKAPEMTNELKNDLKALKMRASMDPKRFYKKNDRDGFPKYFQIGTIVDNPADFYHSRIPKKQRKRTIVEELLADSEFRRYNRRKYSEIMAEKAANAAGKKFRKKKKFRN

SEQ ID NO: 1565 - protein, 386 aa, Homo sapiens
MDRFVWTSGLLEINETLVIQQRGVRIYDGEEKIKFDAGTLLLSTHRLIWRDQKNHECCMAILLSQIVFIEEQAAGIGKSAKIVVHLHPAPPNKEPGPFQSSKNSYIKLSFKEHGQIEFYRRLSEEMTQRRWENMPVSQSLQTNRGPQPGRIRAVGIVGIERKLEEKRKETDKNISEAFEDLSKLMIKAKEMVELSKSIANKIKDKQGDITEDETIRFKSYLLSMGIANPVTRETYGSGTQYHMQLAKQLAGILQVPLEERGGIMSLTEVYCLVNRARGMELLSPEDLVNACKMLEALKLPLRLRVFDSGVMVIELQSHKEEEMVASALETVSEKGSLTSEEFAKLVGMSVLLAKERLLLAEKMGHLCRDDSVEGLRFYPNLFMTQS

SEQ ID NO: 1566 - protein, 122 aa, Homo sapiens
MEEDQELERKAIEELLKEAKRGKTRAETMGPMGWMKCPLASTNKRFLINTIKNTLPSHKEQDHEQKEGDKEPAKSQAQKEENPKKHRSHPYKHSFRARGSASYSPPRKRSSQDKYEKRSNRR

SEQ ID NO: 1567 - protein, 406 aa, Homo sapiens
MAAAVRQDLAQLMNSSGSHKDLAGKYRQILEKAIQLSGAEQLEALKAFVEAMVNENVSLVISRQLLTDFCTHLPNLPDSTAKEIYHFTLEKIQPRVISFEEQVASIRQHLASIYEKEEDWRNAAQVLVGIPLETGQKQYNVDYKLETYLKIARLYLEDDDPVQAEAYINRASLLQNESTNEQLQIHYKVCYARVLDYRRKFIEAAQRYNELSYKTIVHESERLEALKHALHCTILASAGQQRSRMLATLFKDERCQQLAAYGILEKMYLDRIIRGNQLQEFAAMLMPHQKATTADGSSILDRAVIEHNLLSASKLYNNITFEELGALLEIPAAKAEKIASQMITEGRMNGFIDQIDGIVHFETREALPTWDKQIQSLCFQVNNLLEKISQTAPEWTAQAMEAQMAQ

SEQ ID NO: 1568 - protein, 418 aa, Homo sapiens
MATSEQSICQARASVMVYDDTSKKWVPIKPGQQGFSRINIYHNTASNTFRVVGVKLQDQQVVINYSIVKGLKYNQATPTFHQWRDARQVYGLNFASKEEATTFSNAMLFALNIMNSQEGGPSSQRQVQNGPSPDEMDIQRRQVMEQHQQQRQESLERRTSATGPILPPGHPSSAASAPVSCSGPPPPPPPPVPPPPTGATPPPPPPLPAGGAQGSSHDESSMSGLAAAIAGAKLRRVQRPEDASGGSSPSGTSKSDANRASSGGGGGGLMEEMNKLLAKRRKAASQSDKPAEKKEDESQMEDPSTSPSPGTRAASQPPNSSEAGRKPWERSNSVEKPVSSILSRTPSVAKSPEAKSPLQSQPHSRMKPAGSVNDMALDAFDLDRMKQEILEEVVRELHKVKEEIIDAIRQELSGISTT

SEQ ID NO: 1569 - protein, 723 aa, Homo sapiens
MSTATGPEAAPKPSAKSIYEQRKRYSTVVMADVSQYPVNHLVTFCLGEDDGVHTVEDASRKLAVMDSQGRVWAQEMLLRVSPDHVTLLDPASKEELESYPLGAIVRCDAVMPPGRSRSLLLLVCQEPERAQPDVHFFQGLRLGAELIREDIQGALHNYRSGRGERRAAALRATQEELQRDRSPAAETPPLQRRPSVRAVISTVERGAGRGRPQAKPIPEAEEAQRPEPVGTSSNADSASPDLGPRGPDLAVLQAEREVDILNHVFDDVESFVSRLQKSAEAARVLEHRERGRRSRRRAAGEGLLTLRAKPPSEAEYTDVLQKIKYAFSLLARLRGNIADPSSPELLHFLFGPLQMIVNTSGGPEFASSVRRPHLTSDAVALLRDNVTPRENELWTSLGDSWTRPGLELSPEEGPPYRPEFFSGWEPPVTDPQSRAWEDPVEKQLQHERRRRQQSAPQVAVNGHRDLEPESEPQLESETAGKWVLCNYDFQARNSSELSVKQRDVLEVLDDSRKWWKVRDPAGQEGYVPYNILTPYPGPRLHHSQSPARSLNSTPPPPPAPAPAPPPALARPRWDRPRWDSCDSLNGLDPSEKEKFSQMLIVNEELQARLAQGRSGPSRAVPGPRAPEPQLSPGSDASEVRAWLQAKGFSSGTVDALGVLTGAQLFSLQKEELRAVSPEEGARVYSQVTVQRSLLEDKEKVSELEAVMEKQKKKVEGEVEMEVI

SEQ ID NO: 1570 - protein, 559 aa, Homo sapiens
MAETVWSTDTGEAVYRSRDPVRNLRLRVHLQRITSSNFLHYQPAAELGKDLIDLATFRPQPTASGHRPEEDEEEEIVIGWQEKLFSQFEVDLYQNETACQSPLDYQYRQEILKLENSGGKKNRRIFTYTDSDRYTNLEEHCQRMTTAASEVPSFLVERMANVRRRRQDRRGMEGGILKSRIVTWEPSEEFVRNNHVINTPLQTMHIMADLGPYKKLGYKKYEHVLCTLKVDSNGVITVKPDFTGLKGPYRIETEGEKQELWKYTIDNVSPHAQPEEEERERRVFKDLYGRHKEYLSSLVGTDFEMTVPGALRLFVNGEVVSAQGYEYDNLYVHFFVELPTAHWSSPAFQQLSGVTQTCTTKSLAMDKVAHFSYPFTFEAFFLHEDESSDALPEWPVLYCEVLSLDFWQRYRVEGYGAVVLPATPGSHTLTVSTWRPVELGTVAELRRFFIGGSLELEDLSYVRIPGSFKGERLSRFGLRTETTGTVTFRLHCLQQSRAFMESSSLQKRMRSVLDRLEGFSQQSSIHNVLEAFRRARRRMQEARESLPQDLVSPSGTLVS

SEQ ID NO: 1571 - protein, 318 aa, Homo sapiens
MAAAAVSGALGRAGWRLLQLRCLPVARCRQALVPRAFHASAVGLRSSDEQKQQPPNSFSQQHSETQGAEKPDPESSHSPPRYTDQGGEEEEDYESEEQLQHRILTAALEFVPAHGWTAEAIAEGAQSLGLSSAAASMFGKDGSELILHFVTQCNTRLTRVLEEEQKLVQLGQAEKRKTDQFLRDAVETRLRMLIPYIEHWPRALSILMLPHNIPSSLSLLTSMVDDMWHYAGDQSTDFNWYTRRAMLAAIYNTTELVMMQDSSPDFEDTWRFLENRVNDAMNMGHTAKQVKSTGEALVQGLMGAAVTLKNLTGLNQRR

SEQ ID NO: 1572 - protein, 296 aa, Homo sapiens
MARCERLRGAALRDVLGRAQGVLFDCDGVLWNGERAVPGAPELLERLARAGKAALFVSNNSRRARPELALRFARLGFGGLRAEQLFSSALCAARLLRQRLPGPPDAPGAVFVLGGEGLRAELRAAGLRLAGDPSAGDGAAPRVRAVLVGYDEHFSFAKLREACAHLRDPECLLVATDRDPWHPLSDGSRTPGTGSLAAAVETASGRQALVVGKPSPYMFECITENFSIDPARTLMVGDRLETDILFGHRCGMTTVLTLTGVSRLEEAQAYLAAGQHDLVPHYYVESIADLTEGLED

SEQ ID NO: 1573 - protein, 2177 aa, Homo sapiens
MEEILRKLQKEASGSKYKAIKESCTWALETLGGLDTIVKIPPHVLREKCLLPLQLALESKNVKLAQHALAGMQKLLSEERFVSMETDSDEKQLLNQILNAVKVTPSLNEDLQVEVMKVLLCITYTPTFDLNGSAVLKIAEVCIETYISSCHQRSINTAVRATLSQMLSDLTLQLRQRQENTIIENPDVPQDFGNQGSTVESLCDDVVSVLTVLCEKLQAAINDSQQLQLLYLECILSVLSSSSSSMHLHRRFTDLIWKNLCPALIVILGNPIHDKTITSAHTSSTSTSLESDSASPGVSDHGRGSGCSCTAPALSGPVARTIYYIAAELVRLVGSVDSMKPVLQSLYHRVLLYPPPQHRVEAIKIMKEILGSPQRLCDLAGPSSTESESRKRSISKRKSHLDLLKLIMDGMTEACIKGGIEACYAAVSCVCTLLGALDELSQGKGLSEGQVQLLLLRLEELKDGAEWSRDSMEINEADFRWQRRVLSSEHTPWESGNERSLDISISVTTDTGQTTLEGELGQTTPEDHSGNHKNSLKSPAIPEGKETLSKVLETEAVDQPDVVQRSHTVPYPDITNFLSVDCRTRSYGSRYSESNFSVDDQDLSRTEFDSCDQYSMAAEKDSGRSDVSDIGSDNCSLADEEQTPRDCLGHRSLRTAALSLKLLKNQEADQHSARLFIQSLEGLLPRLLSLSNVEEVDTALQNFASTFCSGMMHSPGFDGNSSLSFQMLMNADSLYTAAHCALLLNLKLSHGDYYRKRPTLAPGVMKDFMKQVQTSGVLMVFSQAWIEELYHQVLDRNMLGEAGYWGSPEDNSLPLITMLTDIDGLESSAIGGQLMASAATESPFAQSRRIDDSTVAGVAFARYILVGCWKNLIDTLSTPLTGRMAGSSKGLAFILGAEGIKEQNQKERDAICMSLDGLRKAARLSCALGVAANCASALAQMAAASCVQEEKEEREAQEPSDAITQVKLKVEQKLEQIGKVQGVWLHTAHVLCMEAILSVGLEMGSHNPDCWPHVFRVCEYVGTLEHNHFSDGASQPPLTISQPQKATGSAGLLGDPECEGSPPEHSPEQGRSLSTAPVVQPLSIQDLVREGSRGRASDFRGGSLMSGSSAAKVVLTLSTQADRLFEDATDKLNLMALGGFLYQLKKASQSQLFHSVTDTVDYSLAMPGEVKSTQDRKSALHLFRLGNAMLRIVRSKARPLLHVMRCWSLVAPHLVEAACHKERHVSQKAVSFIHDILTEVLTDWNEPPHFHFNEALFRPFERIMQLELCDEDVQDQVVTSIGELVEVCSTQIQSGWRPLFSALETVHGGNKSEMKEYLVGDYSMGKGQAPVFDVFEAFLNTDNIQVFANAATSYIMCLMKFVKGLGEVDCKEIGDCAPAPGAPSTDLCLPALDYLRRCSQLLAKIYKMPLKPIFLSGRLAGLPRRLQEQSASSEDGIESVLSDFDDDTGLIEVWIILLEQLTAAVSNCPRQHQPPTLDLLFELLRDVTKTPGPGFGIYAVVHLLLPVMSVWLRRSHKDHSYWDMASANFKHAIGLSCELVVEHIQSFLHSDIRYESMINTMLKDLFELLVACVAKPTETISRVGCSCIRYVLVTAGPVFTEEMWRLACCALQDAFSATLKPVKDLLGCFHSGTESFSGEGCQVRVAAPSSSPSAEAEYWRIRAMAQQVFMLDTQCSPKTPNNFDHAQSCQLIIELPPDEKPNGHTKKSVSFREIVVSLLSHQVLLQNLYDILLEEFVKGPSPGEEKTIQVPEAKLAGFLRYISMQNLAVIFDLLLDSYRTAREFDTSPGLKCLLKKVSGIGGAANLYRQSAMSFNIYFHALVCAVLTNQETITAEQVKKVLFEDDERSTDSSQQCSSEDEDIFEETAQVSPPRGKEKRQWRARMPLLSVQPVSNADWVWLVKRLHKLCMELCNNYIQMHLDLENCMEEPPIFKGDPFFILPSFQSESSTPSTGGFSGKETPSEDDRSQSREHMGESLSLKAGGGDLLLPPSPKVEKKDPSRKKEWWENAGNKIYTMAADKTISKLMTEYKKRKQQHNLSAFPKEVKVEKKGEPLGPRGQDSPLLQRPQHLMDQGQMRHSFSAGPELLRQDKRPRSGSTGSSLSVSVRDAEAQIQAWTNMVLTVLNQIQILPDQTFTALQPAVFPCISQLTCHVTDIRVRQAVREWLGRVGRVYDIIV

SEQ ID NO: 1574 - protein, 1154 aa, Homo sapiens
MQAMEGEVLLPALYEEEEEEEEEEEEVEEEEEQVQKGGSVGSLSVNKHRGLSLTETELEELRAQVLQLVAELEETRELAGQHEDDSLELQGLLEDERLASAQQAEVFTKQIQQLQGELRSLREEISLLEHEKESELKEIEQELHLAQAEIQSLRQAAEDSATEHESDIASLQEDLCRMQNELEDMERIRGDYEMEIASLRAEMEMKSSEPSGSLGLSDYSGLQEELQELRERYHFLNEEYRALQESNSSLTGQLADLESERTQRATERWLQSQTLSMTSAESQTSEMDFLEPDPEMQLLRQQLRDAEEQMHGMKNKCQELCCELEELQHHRQVSEEEQRRLQRELKCAQNEVLRFQTSHSVTQNEELKSRLCTLQKKYDTSQDEQNELLKMQLQLQTELRQLKVMKSTLVENQSEKELLCRLQKLHLQHQNVTCEKEKLLERQQQLQEELQCHEAELQHLRDTVASFKESNEKDTETHAQLQEMKQLYQASKDELERQKHMYDQLEQDLLLCQLELKELKASHPIPEDKGKCANKCDTLLSRLTELQEKYKASQKEMGQLQMEQCELLEDQRRMQEEQGQLQEELHRLTLPLPKSGLLLKSQELLTKLEDLCELQLLYQGMQEEQKKLIQNQDCVLKEQLEIHEELRRFKESHFQEVLENPDDSKLAKSSKCNRNKQSKLLMEQMQALQVMYDAGQAKQELLQQEQGRLLEERKRLQADLQLCLEEMQLLQVQSPSIKMSLESYGKSYGSMVPSNENCRKTYDTTVDDNESYYKSYTSTQTSSKSFLKSYDSSTSASEAYGKSYCTTSNSSITYKKSYGSTSSSDTCQKSFVSSCTDEEPAEPEDMERFEEMVVKVLIKLQAVQAMYQISQEEHSQLQEQMEKLLAKQKDLKEELDACEREFKECMECLEKPMAPQNDKNEIKELQTKLRELQLQYQASMDEQGRLLVVQEQLEGQLQCCQEELRQLREKRPSVVKEARGKNANKNMNKNANGVKMKKVTKPCSDTSESDLETRKSLEVVLYYKASQRKLDGLAKEEEKKEEMEEEKKEVKEEAKEQCGDELVAEPADPEEAKSTEDQEENEEDKEEEEKEEDSEEEEDDADSSLESPEENNPLRLSESKKSSPTPNPPIFSLPLVGLVVISALLWCWWAETSS

SEQ ID NO: 1575 - protein, 2443 aa, Homo sapiens
MAAEEGVASAASAGGSWGTAAMGRVLPMLLVPVPAEAMGQLGSRAQLRTQPEALGSLTAAGSLQVLSLTPGSRGGGRCCLEGPFWHFLWEDSRNSSTPTEKPKLLALGENYELLIYEFNLKDGRCDATILYSCSREALQKLIDDQDISISLLSLRILSFHNNTSLLFINKCVILHIIFPERDAAIRVLNCFTLPLPAQAVDMIIDTQLCRGILFVLSSLGWIYIFDVVDGTYVAHVDLALHKEDMCNEQQQEPAKISSFTSLKVSQDLDVAVIVSSSNSAVALNLNLYFRQHPGHLLCERILEDLPIQGPKGVDEDDPVNSAYNMKLAKFSFQIDRSWKAQLSSLNETIKNSKLEVSCCAPWFQDILHLESPESGNHSTSVQSWAFIPQDIMHGQYNVLQKDHAKTSDPGRSWKIMHISEQEEPIELKCVSVTGFTALFTWEVERMGYTITLWDLETQGMQCFSLGTKCIPVDSSGDQQLCFVLTENGLSLILFGLTQEEFLNRLMIHGSASTVDTLCHLNGWGRCSIPIHALEAGIENRQLDTVNFFLKSKENLFNPSSKSSVSDQFDHLSSHLYLRNVEELIPALDLLCSAIRESYSEPQSKHFSEQLLNLTLSFLNNQIKELFIHTEELDEHLQKGVNILTSYINELRTFMIKFPWKLTDAIDEYDVHENVPKVKESNIWKKLSFEEVIASAILNNKIPEAQTFFRIDSHSAQKLEELIGIGLNLVFDNLKKNNIKEASELLKNMGFDVKGQLLKICFYTTNKNIRDFLVEILKEKNYFSEKEKRTIDFVHQVEKLYLGHFQENMQIQSFPRYWIKEQDFFKHKSVLDSFLKYDCKDEFNKQDHRIVLNWALWWDQLTQESILLPRISPEEYKSYSPEALWRYLTARHDWLNIILWIGEFQTQHSYASLQQNKWPLLTVDVINQNTSCNNYMRNEILDKLARNGVFLASELEDFECFLLRLSRIGGVIQDTLPVQNYKTKEGWDFHSQFILYCLEHSLQHLLYVYLDCYKLSPENCPFLEKKELHEAHPWFEFLVQCRQVASNLTDPKLIFQASLANAQILIPTNQASVSSMLLEGHTLLALATTMYSPGGVSQVVQNEENENCLKKVDPQLLKMALTPYPKLKTALFPQCTPPSVLPSDITIYHLIQSLSPFDPSRLFGWQSANTLAIGDAWSHLPHFSSPDLVNKYAIVERLNFAYYLHNGRPSFAFGTFLVQELIKSKTPKQLIQQVGNEAYVIGLSSFHIPSIGAACVCFLELLGLDSLKLRVDMKVANIILSYKCRNEDAQYSFIRESVAEKLSKLADGEKTTTEELLVLLEEGTWNSIQQQEIKRLSSESSSQWALVVQFCRLHNMKLSISYLRECAKANDWLQFIIHSQLHNYHPAEVKSLIQYFSPVIQDHLRLAFENLPSVPTSKMDSDQVCNKCPQELQGSKQEMTDLFEILLQCSEEPDSWHWLLVEAVKQQAPILSVLASCLQGASAISCLCVWIITSVEDNVATEAMGHIQDSTEDHTWNLEDLSVIWRTLLTRQKSKTLIRGFQLFFKDSPLLLVMEMYELCMFFRNYKEAEAKLLEFQKSLETLNTAATKVHPVIPAMWLEDQVCFLLKLMLQQCKTQYELGKLLQLFVEREHLFSDGPDVKKLCILCQILKDTSIAINHTIITSYSIENLQHECRSILERLQTDGQFALARRVAELAELPVDNLVIKEITQEMQTLKHIEQWSLKQARIDFWKKCHENFKKNSISSKAASSFFSTQAHVACEHPTGWSSMEERHLLLTLAGHWLAQEDVVPLDKLEELEKQIWLCRITQHTLGRNQEETEPRFSRQISTSGELSFDSLASEFSFSKLAALNTSKYLELNSLPSKETCENRLDWKEQESLNFLIGRLLDDGCVHEASRVCRYFHFYNPDVALVLHCRALASGEASMEDLHPEIHALLQSAELLEEEAPDIPLRRVHSTSSLDSQKFVTVPSSNEVVTNLEVLTSKCLHGKNYCRQVLCLYDLAKELGCSYTDVAAQDGEAMLRKILASQQPDRCKRAQAFISTQGLKPDTVAELVAEEVTRELLTSSQGTGHKQMFNPTEESQTFLQLTTLCQDRTLVGMKLLDKISSVPHGELSCTTELLILAHHCFTLTCHMEGIIRVLQAAHMLTDNHLAPSEEYGLVVRLLTGIGRYNEMTYIFDLLHKKHYFEVLMRKKLDPSGTLKTALLDYIKRCRPGDSEKHNMIALCFSMCREIGENHEAAARIQLKLIESQPWEDSLKDGHQLKQLLLKALTLMLDAAESYAKDSCVRQAQHCQRLTKLITLQIHFLNTGQNTMLINLGRHKLMDCILALPRFYQASIVAEAYDFVPDWAEILYQQVILKGDFNYLEEFKQQRLLKSSIFEEISKKYKQHQPTDMVMENLKKLLTYCEDVYLYYKLAYEHKFYEIVNVLLKDPQTGCCLKDMLAG

SEQ ID NO: 1576 - protein, 648 aa, Homo sapiens
MSWLFGVNKGPKGEGAGPPPPLPPAQPGAEGGGDRGLGDRPAPKDKWSNFDPTGLERAAKAARELEHSRYAKEALNLAQMQEQTLQLEQQSKLKEYEAAVEQLKSEQIRAQAEERRKTLSEETRQHQARAQYQDKLARQRYEDQLKQQQLLNEENLRKQEESVQKQEAMRRATVEREMELRHKNEMLRVETEARARAKAERENADIIREQIRLKASEHRQTVLESIRTAGTLFGEGFRAFVTDRDKVTATVAGLTLLAVGVYSAKNATAVTGRFIEARLGKPSLVRETSRITVLEALRHPIQVSRRLLSRPQDVLEGVVLSPSLEARVRDIAIATRNTKKNRGLYRHILLYGPPGTGKTLFAKKLALHSGMDYAIMTGGDVAPMGREGVTAMHKLFDWANTSRRGLLLFMDEADAFLRKRATEEISKDLRATLNAFLYHMGQHSNKFMLVLASNLPEQFDCAINSRIDVMVHFDLPQQEERERLVRLHFDNCVLKPATEGKRRLKLAQFDYGRKCSEVARLTEGMSGREIAQLAVSWQATAYASKDGVLTEAMMDACVQDAVQQYRQKMRWLKAEGPGRGVEHPLSGVQGETLTSWSLATDPSYPCLAGPCTFRICSWMGTGLCPGPLSPRMSCGGGRPFCPPGHPLL

SEQ ID NO: 1577 - protein, 1043 aa, Homo sapiens
MRRFKRKHLTAIDCQHLARSHLAVTQPFGQRWTNRDPNHGLYPKPRTKRGSRGQGSQRCIPEFFLAGKQPCTNDMAKSNSVGQDSCQDSEGDMIFPAESSCALPQEGSAGPGSPGSAPPSRKRSWSSEEESNQATGTSRWDGVSKKAPRHHLSVPCTRPREARQEAEDSTSRLSAESGETDQDAGDVGPDPIPDSYYGLLGTLPCQEALSHICSLPSEVLRHVFAFLPVEDLYWNLSLVCHLWREIISDPLFIPWKKLYHRYLMNEEQAVSKVDGILSNCGIEKESDLCVLNLIRYTATTKCSPSVDPERVLWSLRDHPLLPEAEACVRQHLPDLYAAAGGVNIWALVAAVVLLSSSVNDIQRLLFCLRRPSSTVTMPDVTETLYCIAVLLYAMREKGINISNRIHYNIFYCLYLQENSCTQATKVKEEPSVWPGKKTIQLTHEQQLILNHKMEPLQVVKIMAFAGTGKTSTLVKYAEKWSQSRFLYVTFNKSIAKQAERVFPSNVICKTFHSMAYGHIGRKYQSKKKLNLFKLTPFMVNSVLAEGKGGFIRAKLVCKTLENFFASADEELTIDHVPIWCKNSQGQRVMVEQSEKLNGVLEASRLWDNMRKLGECTEEAHQMTHDGYLKLWQLSKPSLASFDAIFVDEAQDCTPAIMNIVLSQPCGKIFVGDPHQQIYTFRGAVNALFTVPHTHVFYLTQSFRFGVEIAYVGATILDVCKRVRKKTLVGGNHQSGIRGDAKGQVALLSRTNANVFDEAVRVTEGEFPSRIHLIGGIKSFGLDRIIDIWILLQPEEERRKQNLVIKDKFIRRWVHKEGFSGFKRYVTAAEDKELEAKIAVVEKYNIRIPELVQRIEKCHIEDLDFAEYILGTVHKAKGLEFDTVHVLDDFVKVPCARHNLPQLPHFRVESFSEDEWNLLYVAVTRAKKRLIMTKSLENILTLAGEYFLQAELTSNVLKTGVVRCCVGQCNNAIPVDTVLTMKKLPITYSNRKENKGGYLCHSCAEQRIGPLAFLTASPEQVRAMERTVENIVLPRHEALLFLVF

SEQ ID NO: 1578 - protein, 885 aa, Homo sapiens
MSHPDYRMNLRPLGTPRGVSAVAGPHDIGASPGDKKSKNRSTRGKKKSIFETYMSKEDVSEGLKRGTLIQGVLRINPKKFHEAFIPSPDGDRDIFIDGVVARNRALNGDLVVVKLLPEEHWKVVKPESNDKETEAAYESDIPEELCGHHLPQQSLKSYNDSPDVIVEAQFDGSDSEDGHGITQNVLVDGVKKLSVCVSEKGREDGDAPVTKDETTCISQDTRALSEKSLQRSAKVVYILEKKHSRAATGFLKLLADKNSELFRKYALFSPSDHRVPRIYVPLKDCPQDFVARPKDYANTLFICRIVDWKEDCNFALGQLAKSLGQAGEIEPETEGILTEYGVDFSDFSSEVLECLPQGLPWTIPPEEFSKRRDLRKDCIFTIDPSTARDLDDALSCKPLADGNFKVGVHIADVSYFVPEGSDLDKVAAERATSVYLVQKVVPMLPRLLCEELCSLNPMSDKLTFSVIWTLTPEGKILDEWFGRTIIRSCTKLSYEHAQSMIESPTEKIPAKELPPISPEHSSEEVHQAVLNLHGIAKQLRQQRFVDGALRLDQLKLAFTLDHETGLPQGCHIYEYRESNKLVEEFMLLANMAVAHKIHRAFPEQALLRRHPPPQTRMLSDLVEFCDQMGLPVDFSSAGALNKSLTQTFGDDKYSLARKEVLTNMCSRPMQMALYFCSGLLQDPAQFRHYALNVPLYTHFTSPIRRFADVLVHRLLAAALGYRERLDMAPDTLQKQADHCNDRRMASKRVQELSTSLFFAVLVKESGPLESEAMVMGILKQAFDVLVLRYGVQKRIYCNALALRSHHFQKVGKKPELTLVWEPEDMEQEPAQQVITIFSLVEVVLQAESTALKYSAILKRPGTQGHLGPEKEEEESDGEPEDSSTS

SEQ ID NO: 1579 - protein, 381 aa, Homo sapiens
MALKAEGAALDCFEVTLKCEEGEDEEEAMVVAVIPRPEPMLRVTQQEKTPPPRPSPLEAGSDGCEEPKQQVSWEQEFLVGSSPGGSGRALCMVCGAEIRAPSADTARSHILEQHPHTLDLSPSEKSNILEAWSEGVALLQDVRAEQPSPPNSDSGQDAHPDPDANPDAARMPAEIVVLLDSEDNPSLPKRSRPRGLRPLELPAVPATEPGNKKPRGQRWKEPPGEEPVRKKRGRPMTKNLDPDPEPPSPDSPTETFAAPAEVRHFTDGSFPAGFVLQLFSHTQLRGPDSKDSPKDREVAEGGLPRAESPSPAPPPGLRGTLDLQVIRVRMEEPPAVSLLQDWSRHPQGTKRVGAGDTSDWPTVLSESSTTVAGKPEKGNGV

SEQ ID NO: 1580 - protein, 896 aa, Homo sapiens
MDGAAGPGDGPAREALQSLSQRLRVQEQEMELVKAALAEALRLLRLQVPPSSLQGSGTPAPPGDSLAAPPGLPPTCTPSLVSRGTQTETEVELKSSPGPPGLSNGPPAPQGASEEPSGTQSEGGGSSSSGAGSPGPPGILRPLQPPQRADTPRRNSSSSSSPSERPRQKLSRKAISSANLLVRSGSTESRGGKDPLSSPGGPGSRRSNYNLEGISVKMFLRGRPITMYIPSGIRSLEELPSGPPPETLSLDWVYGYRGRDSRSNLFVLRSGEVVYFIACVVVLYRPGGGPGGPGGGGQRHYRGHTDCVRCLAVHPDGVRVASGQTAGVDKDGKPLQPVVHIWDSETLLKLQEIGLGAFERGVGALAFSAADQGAFLCVVDDSNEHMLSVWDCSRGMKLAEIKSTNDSVLAVGFNPRDSSCIVTSGKSHVHFWNWSGGVGVPGNGTLTRKQGVFGKYKKPKFIPCFVFLPDGDILTGDSEGNILTWGRSPSDSKTPGRGGAKETYGIVAQAHAHEGSIFALCLRRDGTVLSGGGRDRRLVQWGPGLVALQEAEIPEHFGAVRAIAEGLGSELLVGTTKNALLRGDLAQGFSPVIQGHTDELWGLCTHPSQNRFLTCGHDRQLCLWDGESHALAWSIDLKETGLCADFHPSGAVVAVGLNTGRWLVLDTETREIVSDVIDGNEQLSVVRYSPDGLYLAIGSHDNVIYIYSVSSDGAKSSRFGRCMGHSSFITHLDWSKDGNFIMSNSGDYEILYWDVAGGCKQLKNRYESRDREWATYTCVLGFHVYGVWPDGSDGTDINSLCRSHNERVVAVADDFCKVHLFQYPCARAKAPSRMYGGHGSHVTSVRFTHDDSHLVSLGGKDASIFQWRVLGAGGAGPAPATPSRTPSLSPASSLDV

SEQ ID NO: 1581 - protein, 445 aa, Homo sapiens [sequence omitted]

SEQ ID NO: 1582 - protein, 641 aa, Homo sapiens; identical to SEQ ID NO: 1334

SEQ ID NO: 1583 - protein, 436 aa, Homo sapiens
MRLARLLRGAALAGPGPGLRAAGFSRSFSSDSGSSPASERGVPGQVDFYARFSPSPLSMKQFLDFGSVNACEKTSFMFLRQELPVRLANIMKEISLLPDNLLRTPSVQLVQSWYIQSLQELLDFKDKSAEDAKAIYDFTDTVIRIRNRHNDVIPTMAQGVIEYKESFGVDPVTSQNVQYFLDRFYMSRISIRMLLNQHSLLFGGKGKGSPSHRKHIGSINPNCNVLEVIKDGYENARRLCDLYYINSPELELEELNAKSPGQPIQVVYVPSHLYHMVFELFKNAMRATMEHHANRGVYPPIQVHVTLGNEDLTVKMSDRGGGVPLRKIDRLFNYMYSTAPRPRVETSRAVPLAGFGYGLPISRLYAQYFQGDLKLYSLEGYGTDAVIYIKALSTDSIERLPVYNKAAWKHYNTNHEADDWCVPSREPKDMTTFRSA

SEQ ID NO: 1584 - protein, 829 aa, Homo sapiens
MGLPRGPLASLLLLQVCWLQCAASEPCRAVFREAEVTLEAGGAEQEPGQALGKVFMGCPGQEPALFSTDNDDFTVRNGETVQERRSLKERNPLKIFPSKRILRRHKRDWVVAPISVPENGKGPFPQRLNQLKSNKDRDTKIFYSITGPGADSPPEGVFAVEKETGWLLLNKPLDREEIAKYELFGHAVSENGASVEDPMNISIIVTDQNDHKPKFTQDTFRGSVLEGVLPGTSVMQVTATDEDDAIYTYNGVVAYSIHSQEPKDPHDLMFTIHRSTGTISVISSGLDREKVPEYTLTIQATDMDGDGSTTTAVAVVEILDANDNAPMFDPQKYEAHVPENAVGHEVQRLTVTDLDAPNSPAWRATYLIMGGDDGDHFTITTHPESNQGILTTRKGLDFEAKNQHTLYVEVTNEAPFVLKLPTSTATIVVHVEDVNEAPVFVPPSKVVEVQEGIPTGEPVCVYTAEDPDKENQKISYRILRDPAGWLAMDPDSGQVTAVGTLDREDEQFVRNNIYEVMVLAMDNGSPPTTGTGTLLLTLIDVNDHGPVPEPRQITICNQSPVRQVLNITDKDLSPHTSPFQAQLTDDSDIYWTAEVNEEGDTVVLSLKKFLKQDTYDVHLSLSDHGNKEQLTVIRATVCDCHGHVETCPGPWKGGFILPVLGAVLALLFLLLVLLLLVRKKRKIKEPLLLPEDDTRDNVFYYGEEGGGEEDQDYDITQLHRGLEARPEVVLRNDVAPTIIPTPMYRPRPANPDEIGNFIIENLKAANTDPTAPPYDTLLVFDYEGSGSDAASLSSLTSSASDQDQDYDYLNEWGSRFKKLADMYGGGEDD
